United States Patent 11,141,474 (ARTIFICIAL NUCLEIC ACID MOLECULES ENCODING A NOROVIRUS ANTIGEN AND USES THEREOF) - sequence listing, part 9

SEQ ID NO: 19488 - RNA, 1620 nt, Artificial Sequence
  derived and/or modified sequence opt3 from capsid_protein__Norovirus__BAF95501
augaagauggccagcaacgacgugaaucccuccgauggcucugcugcaaaccuggucccugagguuaauaacgaagugauggcccucgagccaguagugggggcggcuaucgccgcaccggucgccggacagcaaaauauuauagaccccuggaucagaaacaauuucgugcaggcuccugguggcgaauuuaccguuucaccaaggaacgcacccggggagauucuuuggagugccccucugggaccagauuugaaucccuacuuaagccaccugucccggauguauaacggcuacgcugguggguucgaagugcaggucauccuagccggaaaugcguuuacagcaggcaaagugauuuucgccgcuguaccuccaaacuuuccgacugagggccucucucccucgcagguuacgauguucccucauaucauaguggacguccgccaacuggagccagugcuuaucccccugccugaugugcgaaauaacuuuuaucacuacaaucaggcccaugacucaaccuugaagcucauugcaaugcuguauacaccacugcgugcuaacaacgccggggaugacgucuucacuguuagcugcagagugcucaccaggcccaguccggauuuugacuucaucuuuuuaguaccucccacaguggaaucccggaccaaaccauucacugucccugugcugacaguugaggaaaugaccaauucucgcuuucccauuccacuugagaaguuguacacgggacccagcuccgcguucgugguccagccucagaacgguagauguacuaccgauggcgugcugcuagggacaacucaacucucagccguaaauaucugcaccuucaggggagacguuacacacauagcaggcagucggaacuauaccaugaaucuggcuagccagaacuggaauaacuacgauccaacggaggaaauuccggcuccccuugguacuccugacuuuguggggaaaauccagggacuguugacacagaccacucgcgccgacggcucuacacgagcccauaaggcaaccgucuccacgggcucagugcacuucaccccaaagcucgggagcguccaauuuaguacagauacugacaaugauuuccagcccggacagaacaccaaauuuacaccuguggguguuauucaagacggcgauagacaccagaaugagccacagcagugggugcugcccgacuacucugggaggacuggacauaacguacacuuagccccggcugucgcgccuaccuucccaggcgaacaacugcucuuuuuccgguccacaaugcccgguuguagcggguauccuaauaugaaccuugauugccuguugccccaggagugggugcuacauuuuuaccaggaaucggcaccagcccagucugacguugcucugcuccguuucgugaauccugauaccaaccgcguccuguuugaguguaaacuucacaaguccggcuauaucacuguggcccacacgggacaacaugaccugaucuugcccccaaacggcuacuucagauuugauucauggguaaaucaguucuauacacucgcaccgauggggaacggagccgguaggcggcgagcuccuuga

SEQ ID NO: 19489 - RNA, 1623 nt, Artificial Sequence
  derived and/or modified sequence opt3 from capsid_protein__Norovirus__BAF95503
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaaccaagggcgacgggucaacgcgcggacauaaggccaccguuaguacaggugacgugcacuuuacuccuaagcugggcagcauccaauucaacaccgauacaaauaacgacuuugaaacugggcagaauaccaaauucacaccagucggagugguccaggauggcaacgguacccaccaaaaugagccccagcaguggguguugccgucuuacuccgggcgaacuggccauaacguucaccucgcuccugccguggcaccaacguuucccggagaacagcuguuauucuuuagaucaacaaugccuggcuguagcggguaccccaacaugaaucuggacugccuccuuccacaagaguggguacagcauuucuaucaggaggccgcuccugcgcagagugaugucgcacuguugagguuugugaaccccgacaccggacggguucuauucgaauguaagcugcacaaaucugguuacgugacugucgcccacaccggccaacaugaucucgugauuccaccgaauggguauuuucguuucgacuccuggguaaaccaguucuacacacuggcuccuaugggaaauggcaccggucgcagaagggcccuuuga

SEQ ID NO: 19490 - RNA, 1623 nt, Artificial Sequence
  derived and/or modified sequence opt3 from capsid_protein__Norovirus__BAF95505
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccgucuuaaccguggaagagaugacgaacucccgcuuuccaaucccccuggagaaacuuuucacuggaccuucuggugcguucguugugcagccacagaauggcagauguaccacagacggggucuugcugggaacuacccaacuaagcccggugaacauaugcacauuuaggggcgauguaacccauauugccgguacgcacaauuacacuaugaaccucgcaucccagaauuggaacaauuaugaccccacagaagagaucccugcuccacuggggacccccgauuucguuggacggauucagggcaugcuuacucagacaaccaagggcgacgggucaacgcgcggacauaaggccaccgugaguacaggugacguccacuuuacuccuaagcugggcagcauccaauucaacaccgauacaaauaacgacuuugaaacugggcagaauaccaaauucacaccagugggagucgugcaggauggcaacgguacccaccaaaaugagccccagcaguggguuuugccgucuuacuccgggcgaacuggccauaacgugcaccucgcuccugccguagcaccaacguuucccggagaacagcuguuauucuuuagaucaacaaugccuggcuguagcggguaccccaacaugaaucuggacugccuccuuccacaagaguggguccagcauuucuaucaggaggccgcuccugcgcagagugauguggcacuguugagguuuguuaaccccgacaccggacgggugcuauucgaauguaagcugcacaaaucugguuacgucacuguggcccacaccggccaacaugaucucguaaucccaccgaauggguauuuucguuucgacuccugggugaaccaguucuacacacuggcuccuaugggaaauggcaccggucgcagaagggcccuuuga

SEQ ID NO: 19491 - RNA, 1623 nt, Artificial Sequence; identical to SEQ ID NO: 19464
  derived and/or modified sequence opt3 from capsid_protein__Norovirus__BAF95507

SEQ ID NO: 19492 - RNA, 1623 nt, Artificial Sequence
  derived and/or modified sequence opt3 from capsid_protein__Norovirus__BAF95509
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggggcgacggcagcacgcgcgggcacaaggccaccgugucuacaggauccguccauuuuacuccuaagcuggguucagugcaguucagcaccgauacaaguaaugacuuugagacuggccagaacacccgauucacaccagucggggugguucaagauggaucuaccacucaccagaaugaaccccagcaguggguguugccgaacuacuccggcagagacagccacaauguacaucucgcuccugccgucgcaccaacguuucccggugagcaacuguuauucuuuaggucgacaaugccuggguguucuggcuaccccaacaugaaucuggauugccuccuuccacaggaaugggugcagcacuucuaucaggaguccgccccugcucaaucagacguugcgcuguugcgguuugugaaccccgauaccggacguguccuauucgaguguaaacugcauaagaguggcuacgugacuguagcacacaccgggcagcacgaccucgugaucccaccgaacggauauuuucgcuucgauagcuggguuaaucaguucuacacacuggccccuauggguaacggcgcugggagaaggcgggcccuuuga

SEQ ID NO: 19493 - RNA, 1623 nt, Artificial Sequence; identical to SEQ ID NO: 18149
  derived and/or modified sequence opt3 from capsid_protein__Norovirus__BAF95511

SEQ ID NO: 19494 - RNA, 1623 nt, Artificial Sequence
  derived and/or modified sequence opt3 from capsid_protein__Norovirus__BAF95513
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacucaacuauuaaguugaucgcaaugcucuauaccccacugcgugcuaacaacgccggggaugacguguucacagucagcugcagaguucugaccaggcccaguccggauuuugacuucauuuuucucgugccucccacuguagaaucccggacaaaaccauucucugugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucgccggcacgcagaacuacacuaugaaucucgcaagccagaacuggaauaacuaugauccgacagaggaaauucccgcuccucuggguaccccagacuucguagggaagauccagggaguucuuacucaaacaacccggcgcgacggcucuacgcgaggccacaaggccaccguguccacagggucaguccauuuuacucccaagcugggaagcgugcaguucaguaccgauacaucuaaugacuuugagacuggucagaacaccagauucacaccugucggcgugguucaagauggguccaccacucaccagaaugaaccacagcaguggguguugcccaacuacagcggaagggacucgcacaauguacaucucgcuccggccgucgcaccuacguuuccaggcgagcaacuguuauucuuucggucuacaaugcccgguuguuccggguacccuaacaugaaucuggauugccuccuuccccaggaaugggugcagcacuucuaucaggagucagccccagcucaaagugacguugcgcuguugcguuuugugaacccugauaccggccgcguccuauucgaguguaaacugcauaagagcggauacgugacuguagcacacaccggccagcacgaccucgugauucccccaaacggguauuuuagauucgauuccuggguuaaucaguucuacacacuggccccgaugggaaacggugcuggcaggcggcgagcccuuuga

SEQ ID NO: 19495 - RNA, 1623 nt, Artificial Sequence; identical to SEQ ID NO: 17975
  derived and/or modified sequence opt3 from capsid_protein__Norovirus__BAF95515

SEQ ID NO: 19496 - RNA, 1623 nt, Artificial Sequence
  derived and/or modified sequence opt3 from capsid_protein__Norovirus__BAF95517
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucacugugccuaucuuaacagucgaggaaaugaccaauagccgcuuucccauaccacuggagaaacuuuucacgggacccuccucagccuucgugguucagccucagaacgguagauguacuaccgauggcguguugcuggggacaacucaacuaaguccagucaauauuugcaccuuuaggggagacgugacacauaucagcggcacccggacguaccgcaugaaccucgcaucucagaauuggaacaauuaugauccgacugaggaaauucccgcuccucuggguacaccagacuucguagggaagauccagggaaugcuuacccagacuacaaagggcgacggcuccacccgagggcacaaggccacgguuucaaccggaagcguggauuuuacacccaaacuggguaguguccaauucgcuacugacaccgauaacgacuuugagacaggccagaauacuagauucaccccugugggggucauccaggauggaucuuccgcccauaggaacgaaccacaacaguggguguugcccgacuacagcggccggacaguucacaaugugcaccucgcaccggccguagcuccuaccuuuccaggugagcagcuguuauucuuucguucgacuaugcccggguguucuggcuacccuaacauggaucuggacugccuccuuccccaggaauggguccaacauuucuaucaggaggcggcaccaucccagucagauguggcccuguugcgcuuuguuaauccugacacgggaagagugcuauucgaguguaagcugcacaaagcuggcuacgucacaguggcccauaccgggcagcacgaucucguaauucccccaaacggauauuuuagguucgacaguugggugaaucaauucuacacucuggcaccgauggguaacggcgccgggcggcgacgcgcucuuuga

SEQ ID NO: 19497 - RNA, 1623 nt, Artificial Sequence
  derived and/or modified sequence opt3 from capsid_protein__Norovirus__BAF95519
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacucaacuauuaaguugaucgcaaugcucuauaccccacugcgugcuaacaacgccggggaugacguguucacagucagcugcagaguucugaccaggcccaguccggauuuugacuucauuuuucucgugccucccacuguagaaucccggacaaaaccauucucugugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucgccggcacgcagaacuacacuaugaaucucgcaagccagaacuggaauaacuaugauccgacagaggaaauucccgcuccucuggguaccccagacuucguagggaagauccagggaguucuuacucaaacaaccacgcgggacggcucuacccgcggccacaaggccacaguguccacugggucaguccauuuuacccccaagcugggaagcgugcaguucaguacagauacuucuaaugacuuugagaccggucagaacacacgauucaccccugucggcgugguucaagauggguccacuacgcaccagaaugaaccacagcaguggguguugcccgacuacagcggaagagauucgcacaacguacaucucgcuccggccgucgcaccuacauuuccaggcgagcaacuguuauucuuuaggucuaccaugcccgguuguuccggguacccuaauaugaaccuggacugccuccuuccccaggaaugggugcagcacuucuaucaggagucagccccagcucaaagugauguugcgcuguugcgguuugugaauccugacacuggccguguccuauucgaguguaaacugcauaagagcggauacgugaccguagcacacacaggccagcacgaucucgugauucccccaaacggguauuuucgcuucgacuccuggguuaaccaguucuacacccuggccccgaugggaaauggugcuggcagaaggcgggcccuuuga

SEQ ID NO: 19498 - RNA, 1623 nt, Artificial Sequence
  derived and/or modified sequence opt3 from capsid_protein__Norovirus__BAF95521
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguagguaagauccaggggguucuuacccaaacuacacggcgcgacggauccacccgaggccacaaggccacggugucaaccggcagcguccauuuuacaccuaagcuggggagaauccaguucaguacugauaccucuaacgacuuugaaacaggacagaauacuagguucaccccagugggugucgugcaagauggcgggacaacccaccagaacgagccccagcaguggguuuugccgaauuacuccggacgggacagccacaacgugcaucucgcuccugccguagcaccaucguuucccggcgaacaacuguuauucuuucguucuacuaugccugguuguuccggguaccccaauaugaaccuggauugccuccuuccacaggaguggguccagcacuucuaucaggaggccgcuccugcgcaaucagacguggcacuguugcgcuuuguuaaucccgauacgggcagagugcuauucgaauguaaacugcauaagaguggauacgucacaguggcccacaccggccagcacgaccucguaauuccaccgaacggguauuuuagguucgauagcugggugaaccaguucuacacucuggcuccuaugggaaaugguaccggccggcgacgcgcccuuuga

SEQ ID NO: 19499 - RNA, 1623 nt, Artificial Sequence; identical to SEQ ID NO: 18675
  derived and/or modified sequence opt3 from capsid_protein__Norovirus__BAF95523

SEQ ID NO: 19500 - RNA, 1623 nt, Artificial Sequence; identical to SEQ ID NO: 17975
  derived and/or modified sequence opt3 from capsid_protein__Norovirus__BAF95525

SEQ ID NO: 19501 - RNA, 1623 nt, Artificial Sequence
  derived and/or modified sequence opt3 from capsid_protein__Norovirus__BAF95527
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgacgugcaggucauucuagcgggaaacgcauuuacugccggcaaaaucauuuucgcugccgugccuccaaauuuuccgacggaaggccucucucccucgcagguaaccauguucccucauaucauaguugaugugcgccaacuggagccaguccuuaucccccugccugacgugcgaaacaauuuuuaucacuacaaccagucaaaugauagcacaauuaaguugaucgcaaugcucuauacuccacugcgugcuaacaacgccggggacgauguguucaccgucaguugcagaguucugacaaggcccuccccggacuuugauuucauuuuucucgugccucccaccguagagucucggacuaaaccauucacagugccuaucuuaaccgucgaagagaugacgaauagccgcuuucccauaccacuggaaaaacuuuucacuggacccuccucagcguucgugguucagccucagaacgguagauguaccacagacggcguguugcuggggacuacccaacuaaguccagucaauauuugcacauuuaggggagaugugacccauaucccgggcacgcggacuuaccgcaugaaccucgccagccagaauuggaacaauuaugaccccacagaggagauuccugcaccacuggguacccccgacuucguagggaagauccagggaaugcuuacucagacaaccaagggcgauggcucuacgcgagggcacaaggcuaccguuuccacaggaucaguggacuuuacuccuaaacuggguagcguccaauucgccaccgauacagacaacgauuuugaaacuggccagaauaccagauucacaccagugggggucauccaggacggaaguucuacccauaggaacgagccccaacaguggguguugccggauuacuccggccggacuguucacaaugugcaccucgcuccugccguagcaccaacguuucccggugaacagcuguuauucuuucguagcacaaugccuggguguucgggcuaccccaacauggaccuggauugccuccuuccacaggaguggguccaacauuucuaucaggaagccgcuccuucucaguccgacguggcgcuguugcgcuuuguuaaucccgauaccggaagagugcuauucgaguguaagcugcacaaagcaggcuacgucacuguggcccauaccgggcagcacgaccucguaauuccaccgaacggauauuuuagguucgacucaugggugaaucaauucuacacacuggcuccuauggguaacggcgccgggcggcgacgcgcacuuuga

SEQ ID NO: 19502 - RNA, 1623 nt, Artificial Sequence
  derived and/or modified sequence opt3 from capsid_protein__Norovirus__BAF95529
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcaugcugacacagaccacuaagggcgacgggagcacacgcggacacaaggcuaccguuuacacggguucugcccccuuuaccccuaaauugggcuccgugcaguucucaacagacacugaaaacgauuuugagacccaucaaaauacaaaguucacuccagucggggugauccaggacggaagcaccacacaccgaaacgaaccccagcaauggguccucccgaguuacucuggcagaaaugugcacaacguucaucuggccccugcaguggcuccaaccuuucccggugagcaguuacuguucuuuagguccacuaugccuggguguagcggcuaucccaauauggaucucgacugccuucugccacaggaguggguacagcacuucuaccaagaagcggccccugcacagucggaugucgcuuugcuacgguuugugaaccccgacacgggacguguucuguucgaguguaaacuccauaagucuggcuaugugacagucgcccacaccgggcagcacgaucuggugauuccaccgaacggauacuuucgcuucgacuccuggguaaaucaguucuauacucuugcaccuauggguaacggcaccgggagaaggcgggcccuguga

SEQ ID NO: 19503 - RNA, 1623 nt, Artificial Sequence; identical to SEQ ID NO: 18112
  derived and/or modified sequence opt3 from capsid_protein__Norovirus__BAF95531

SEQ ID NO: 19504 - RNA, 1623 nt, Artificial Sequence; identical to SEQ ID NO: 18816
  derived and/or modified sequence opt3 from capsid_protein__Norovirus__BAG30923

SEQ ID NO: 19505 - RNA, 1629 nt, Artificial Sequence
  derived and/or modified sequence opt3 from capsid_protein__Norovirus__BAG34630
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaaugucaccaucacgaacuuaaaugguucacccuucgacccuagugaagauauuccagcuccgcugggggugcccgacuuccagggaaggguauuuggcguuaucagccaacgggauaagcagaacgccgcuggccacaaugagccugccaaccgcgggcaugacgcaguggucccaacuuacacagcccaguacacccccaaacucggacaaauacagauugguacuuggcagacagaugaccuuaccgugaaucagccugucaaguucacgccagugggccugaacgauaccgaacacuuuaaucaauggguugugccccgauaugcuggggcguugaaccuaaauacaaaccuggcaccgucuguagccccugucuucccaggagagagacuccuguuuuucagguccuacaucccccuuaaaggcgguuaugggaauccugcuauugacugccuguugccccaggagugggugcagcauuuuuaccaggaagccgcaccaucaaugagcgagguugcccucgugcgguauaucaacccugauacuggccgugcucuguucgaagccaaguuacaccgcgcaggauuuaugaccgucaguucuaacacauccgcgcccgugguagugccagcuaauggcuacuucagauuugacagcuggguuaaccaauucuauucgcuggccccgauggggacuggaaaugguaggcggcgaguccaguga

SEQ ID NO: 19506 - RNA, 1629 nt, Artificial Sequence
  derived and/or modified sequence opt3 from capsid_protein__Norovirus__BAG34632
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguuuaccucuccaaacgaggucaucagcgugcagugucagaaugguagaugcacacuugacggcgaacugcaagggacuacccaguugcagguuuccggaauuuguguguucaagggcgaggucacagcccaccuccaugauaacgaccaccuguacaauaucaccauuacgaacuuaaaugguucacccuucgacccuagugaagaugugccagcaccgcuggggguacccgacuuucagggaaggguuuucggcgugaucagccaacgggauaaccacaaugcuucuggccauaaccagccugccaaucgcgggcacgacgcugucgugccaacuuauacagcccaguacacccccaagcucggacaaauacagauugguacuuggcagacagaugaccuuaccgucaaccagccugugaaauuuacgccaguuggccugaaugauguggagcauuucaaccaauggguagucccccgauacgcaggggccuugaaucuaaacaccaaucuggcuccguccguggcgccuguuuuuccaggagaaagacuccuguucuuuaggucauaucuuccccugaagggcgguuacgggaacccugugaucgacugcuugcucccccaggaguggguccagcacuucuaucaggaggcagccccaagcaugagugaaguggcucugguacgguacauuaacccugauacaggccgugccuuauuugaggcaaaacugcaccgcgccggauucaugacugugucuuccaauaccagcgcucccguugucgugccagccaacggcuauuuuagauucgacucgugggugaaucaauuuuacucucuagcaccgauggggacaggaaacgguaggcggcgaauccaguga

SEQ ID NO: 19507 - RNA, 1629 nt, Artificial Sequence
  derived and/or modified sequence opt3 from capsid_protein__Norovirus__BAG34634
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuuccccgugucuauagaucagauguacaccagcccaaacgaggucaucuccgugcagugucagaacgguagaugcacacuugacggcgaacugcaagggacuacccaguugcagguuucaggaauuugugccuuuaagggcgaggugacagcacaccuccaugauaaugaccaccuguauaacgucaccaucacgaauuuaaacgguagucccuucgacccuagcgaagauauuccagcuccgcugggggugcccgacuuccagggaaggguauuuggcguuaucucucaacgggauaagcacaaugccuccggccauaacgagccugcuaaucgcgggcacgacgccguggucccaacuuacacagcacaguacacccccaaacucggacagauacaaauugguacuuggcagacagaugaccuuaccgugaaccagccugucaaguucacgccagugggccugaaugauaccgaacauuuuaaccaguggguugugccccgauaugccggggcuuugaaucuaaacacaaaucuggcgccgucaguagcaccugucuucccaggagagagacuccuguuuuucaggagcuacaucccccuuaaaggcgguuaugggaacccugccauugacugccuguugccccaagagugggugcagcacuuuuaccaggaagcugccccaaguaugucugagguugcacucgugcgguauaucaauccugauacuggccgugcccuguucgaagcuaaguuacaccgcgccggauuuaugaccgucuccagcaacacaucggcacccgugguagugccagcgaacggcuacuucagauuugacucuuggguuaaucaguucuauucccuggcuccgauggggacuggaaacgguaggcggcgaguccaauga

SEQ ID NO: 19508 - RNA, 1629 nt, Artificial Sequence
  derived and/or modified sequence opt3 from capsid_protein__Norovirus__BAG34636
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguuuaccucuccaaacgaggucaucagcgugcagugucagaaugguagaugcacacuugacggcgaacugcaaggguccacucaguugcagguuucaggaauuugugccuucaagggcgaggugaccgcacaccuccaugauaacgaccaccuguacaauaucacaauuaccaacuuaaaugguagucccuucgacccuagcgaagaugucccagcuccgcugggggugcccgacuuucagggaaggguauucggcguuaucucucaacgggauaaccacaaugccuccggccauaaccagccugcuaaucgcgggcacgacgccguggucccaacguauacuucacaguacacacccaagcucggacaaauacagauugguaccuggcagacugaugaccuuacagugaaccagccugucaaauuuaccccagugggccugaaugauguugagcauuucaaccaaugggugguaccccgauacgcaggggccuugaaucuaaacacgaaucuggcuccgagcgucgcgccuguguuuccaggagaaagacuccuguucuuuaggaguuaucuuccccugaagggcgguuacgggaacccugcaaucgacugcuugcucccccaggaguggguucagcacuucuaucaggaggccgcuccaucuauguccgaaguggcccugguccgguacauuaacccugauaccggccgugcauuauuugaggccaaacugcaccgcgcuggauucaugacagugagcucgaauacuucugcccccguagugguuccagcaaacggcuauuuuagauucgacuccugggucaaucaauuuuacucacuagcgccgauggggaccggaaacgguaggcggcgaauccaguga

SEQ ID NO: 19509 - RNA, 1629 nt, Artificial Sequence; identical to SEQ ID NO: 18048
  derived and/or modified sequence opt3 from capsid_protein__Norovirus__BAG34638

SEQ ID NO: 19510 - RNA, 1629 nt, Artificial Sequence; identical to SEQ ID NO: 18048
  derived and/or modified sequence opt3 from capsid_protein__Norovirus__BAG34640

SEQ ID NO: 19511 - RNA, 1629 nt, Artificial Sequence; identical to SEQ ID NO: 18048
  derived and/or modified sequence opt3 from capsid_protein__Norovirus__BAG34642

SEQ ID NO: 19512 - RNA, 1629 nt, Artificial Sequence; identical to SEQ ID NO: 18048
  derived and/or modified sequence opt3 from capsid_protein__Norovirus__BAG34644

SEQ ID NO: 19513 - RNA, 1629 nt, Artificial Sequence; identical to SEQ ID NO: 18048
  derived and/or modified sequence opt3 from capsid_protein__Norovirus__BAG34646

SEQ ID NO: 19514 - RNA, 1629 nt, Artificial Sequence
  derived and/or modified sequence opt3 from capsid_protein__Norovirus__BAG34648
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuuccccgugucuauagaucagauguacaccagcccaaacgaggucaucuccgugcagugucagaacgguagaugcacacuugacggcgaacugcaagggucaacucaguugcagguuaguggaauuugugccuuuaagggcgaggugaccgcacaccuccaugauaaugaccaccuguauaacgucacaaucaccaauuuaaacgguagccccuucgacccuucugaagauauuccagcuccgcugggggugcccgacuuccagggaaggguauuuggcguuaucucccaacgggauaagcacaauucaccuggccauaacgagccagccaaucgcgggcacgacgcugugguccccacguacacuagccaguacacaccuaaacucggacagauacaaauugguaccuggcagacugaugaccuuacagugaaccagccagucaaguucacccccgugggccugaaugauacggaacauuuuaaccaguggguugugccgcgauaugccggggcauugaaucuaaacaccaaucuggccccuaguguagcuccagucuuccccggagagagacuccuguuuuucaggucuuacaucccucuuaaaggcgguuaugggaaccccgcgauugacugccuguugccacaagagugggugcagcacuuuuaccaggaagcagccccuuccaugagcgagguugcucucgugcgguauaucaaucccgauacaggccgugcccuguucgaagcaaaguuacaccgcgccggauuuaugacugucucgucuaacaccuccgcuccagugguagugccggccaacggcuacuucagauuugacucauggguuaaucaguucuauagucuggcaccuauggggacaggaaacgguaggcggcgaguccaauga

SEQ ID NO: 19515 - RNA, 1629 nt, Artificial Sequence; identical to SEQ ID NO: 18048
  derived and/or modified sequence opt3 from capsid_protein__Norovirus__BAG34650

SEQ ID NO: 19516 - RNA, 1629 nt, Artificial Sequence
  derived and/or modified sequence opt3 from capsid_protein__Norovirus__BAG34652
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaaugucaccaucacgaacuuaaaugguucacccuucgacccuagugaagauauuccagcuccgcugggggugcccgacuuccagggaaggguauuuggcguuaucagccaacgggauaagcacaacucuccuggccauaaugagccagccaaccgcgggcacgacgcugugguccccacuuacacaccucaguacaccccaaaacucggacagauacaaauugguacuuggcagacagaugaccuuaccgugaaucagcccgucaaguucacgccggugggccugaacgauaccgaacauuuuaaucaguggguugugccucgauaugccggggcauugaaccuaaauacaaaccuggccccauccguagcucccgucuucccuggagagagacuccuguuuuucaggucauacaucccccuuaaaggcgguuaugggaauccagcgauugacugccuguugccucaagagugggugcagcacuuuuaccaggaagcagcccccagcaucagugagguugcucucgugcgguauaucaacccagauacuggccgugcccuguucgaagcaaaguuacaccgcgccggauuuaugaccgucucuuccaacacaagcgcuccggugguagugccugccaauggcuacuucagauuugacucguggguuaaccaguucuauucucuggcacccauggggacuggaaaugguaggcggcgaguccaauga

SEQ ID NO: 19517 - RNA, 1629 nt, Artificial Sequence
  derived and/or modified sequence opt3 from capsid_protein__Norovirus__BAG34654
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaaugucaccaucacgaacuuaaaugguucacccuucgacccuagugaagauauuccagcuccgcugggggugcccgacuuccagggaaggguauuuggcguuaucagccaacgggauaagcacaacucuccuggccauaaugaguccgccaaccgcgggcacgacgcuguggucccaacuuacacaucacaguacacccccaaacucggacagauacaaauugguacuuggcagacagaugaccuuaccgugaaucagccugucaaguucacgccagugggccugaacgauaccgaacauuuuaaucaguggguugugccccgauaugccggggcauugaaccuaaauacaaaccuggccccgagcguagcuccugucuucccaggagagagacuccuguuuuucaggaguuacaucccccuuaaaggcgguuaugggaauccugcgauugacugccuguugccccaagagugggugcagcacuuuuaccaggaagcagccccaucuauguccgagguugcucucgugcgguauaucaacccugauacuggccgugcccuguucgaagcaaaguuacaccgcgccggauuuaugaccgucagcucgaacacaucugcucccgugguagugccagccaauggcuacuucagauuugacuccuggguuaaccaguucuauucacuggcaccgauggggacuggaaaugguaggcggcgaguccaauga

SEQ ID NO: 19518 - RNA, 1629 nt, Artificial Sequence
  derived and/or modified sequence opt3 from capsid_protein__Norovirus__BAG34656
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaaugucaccaucacgaacuuaaaugguucacccuucgacccuagugaagauauuccagcuccgcugggggugcccgacuuccagggaaggguauuuggcguuaucagccaacgggauaagcacaacucuccuggccauaaugagccagccaaccgcgggcacgacgcugugguccccacuuacacaucccaguacaccccuaaacucggacagauacaaauugguacuuggcagacagaugaccuuaucgugaaucagccagucaaguucacccccgugggccugaacgauacggaacauuuuaaucaguggguugugccgcgauaugccggggcauugaaccuaaauaccaaccuggccccuucaguagcuccagucuuccccggagagagacuccuguuuuucaggagcuacauuccucuuaaaggcgguuaugggaaucccgcgaucgacugccuguugccacaagagugggugcagcacuuuuaccaggaagcagccccuaguaugucugagguugcucucgugcgguauaucaaccccgauacaggccgugcccuguucgaagcaaaguuacaccgcgccggauuuaugacugucuccagcaacaccucggcuccagugguagugccggccaauggcuacuucagauuugacucuuggguuaaccaguucuauucccuggcaccuauggggacaggaaaugguaggcggcgaguccaauga

SEQ ID NO: 19519 - RNA, 1629 nt, Artificial Sequence; identical to SEQ ID NO: 18048
  derived and/or modified sequence opt3 from capsid_protein__Norovirus__BAG34658

SEQ ID NO: 19520 - RNA, 1629 nt, Artificial Sequence
  derived and/or modified sequence opt3 from capsid_protein__Norovirus__BAG34662
augaagauggccagcaacgacgcugcacccuccaccgauggcgccgcggggcuggugccugagucuaauucagaagucauggcucucgagccaguugccggagcagcccuugcugcaccggugacaggucagacuaacaucauugaccccuggauaagaaguaauuucguacaagccccuaacggcgaauuuacggugagcccaaggaaugcucccggggagguccuguugaacuuagaacugggaccugagcuaaauccauaccucgcccaccuggcgcggauguauaacggcuacgccggugggauggaggugcagguuaugcuugcaggaaaugcuuucaccgccggcaaacugguguuugcagcugugcccccucauuucccagucgaaaacuuguccccgcagcagaucacaauguuuccccacguaauuaucgauguucgcacucucgagccugugcugcugccacuccccgacguccgaaauaacuucuuucauuauaaucaaaaggaugacccuaaaaugcguauuguggccauguuauacaccccacugagaucuaacggcucgggggaugacguguucacagucucaugcaggguucuuacccggcccagcccggauuuugacuucacuuauuuggugccucccacaguagaaaguaagaccaaaccauuuacgcugccuauccuaacucucggagagcuguccaauucucgcuuccccgugagcauagaucagauguacaccuccccaaacgaggucaucucagugcagugucagaacgguagaugcacacuugacggcgaacugcaagggacuacccaguugcagguuaguggaauuugugcguuuaagggcgaggugacagcccaccuccagaaugaugaccaucuguauaacaucaccauuacgaauuuaaacgguagccccuucgacccuucugaagauaucccagcaccgcuggggguccccgacuuccaaggaaggguguuuggcguaauaacucagcgggauaagcagaaugcuacaggccaaaaccagccugccaaucgcgggcacgacgcuguugugccaaccuacacugcccaguacacacccaaacucggacagauucaaaucgguaccuggcagacggaugaccuuaaggucaaccagccugugaaauucaccccagucggccugaaugauacagagcacuuuaaccagugggugguuccccgauaugcaggggccuugaaucuaaacacuaaucuggcuccguccguggcgccuguauucccaggagaaagacuccuguuuuucaggucauaccuuccccugaagggcgguuaugggaacccugcaauugacugcuugcucccccaagaguggguccagcauuuuuaccaggaggccgcuccaagcaugagugaaguggcccugguucgguauaucaauccugauaccggccgugcauuauucgaggccaaacugcaccgcgcuggauuuaugacagugucuuccaacacuagcgcccccgucgugguaccagcaaacggcuacuucagauuugacucgugggugaaucaguucuauucucuagcgccgauggggaccggaaacgguaggcggcgaauccaauga

SEQ ID NO: 19521 - RNA, 1629 nt, Artificial Sequence
  derived and/or modified sequence opt3 from capsid_protein__Norovirus__BAG34664
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaauaucaccauuacgaacuuaaaugguucacccuucgacccuagugaagauacuccagcuccgcuggggguccccgacuuccagggaaggguguuuggcaucauaagccaacgggauaagcagaacgccacaggccacaaugagccugcuaaccgcgggcaugacgccguaguuccaaccuacacugcacaguacacacccaaacucggacaaauucagaucgguaccuggcagacggaugaccuuaccgugaaucagccugucaaguucacaccagugggccugaacgauacugaacacuuuaaucaaugggucgugccccgauaugccggggcuuugaaccuaaauaccaaccuggcgccgucuguugcaccuguguucccaggagagagacuccuguuuuucagguccuacauuccccuuaaaggcgguuaugggaauccugccaucgacugccuguugccccaggaguggguacagcauuuuuaccaggaagcugccccaucaaugagcgaggucgcacucgugcgguauaucaacccugauacaggccgugcccuguucgaagcuaaguuacaccgcgccggauuuaugacuguuaguucuaacaccuccgcacccguggucgugccagcgaauggcuacuucagauuugacagcuggguaaaccaauucuauucgcuggcuccgauggggacaggaaaugguaggcggcgagugcaguga

SEQ ID NO: 19522 - RNA, 1629 nt, Artificial Sequence; identical to SEQ ID NO: 18048
  derived and/or modified sequence opt3 from capsid_protein__Norovirus__BAG34666

SEQ ID NO: 19523 - RNA, 1629 nt, Artificial Sequence
  derived and/or modified sequence opt3 from capsid_protein__Norovirus__BAG34668
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcauucucgagccugugcugcugccacuccccgacguccgaaacaauuucuuucauuauaaccaaaaggaugacccuaaaaugcguaucguggcgauguuauacacuccacugagaagcaauggcuccggggaugacguguucaccgucucuugcaggguucuuacacggcccucgccggauuuugacuucaccuauuuggugccucccacuguagaaucaaagacaaaaccauuuacccugccuauacuaacgcucggagagcugagcaacagucgcuuccccguguccaucgaucagauguacacuucuccaaacgaggucauuagcgugcagugucagaaugguagaugcacccuugacggcgaacugcaagggacaacucaguugcagguuuccggaaucugugccuuuaagggcgaggugaccgcacaccuccaugauaacgaccaccuguauaaugucacaauuaccaacuuaaaugguucacccuucgacccuagugaagauaucccagcuccgcugggggugcccgacuuccagggaaggguauuuggcguuauaagccaacgggauaagcacaacucuccuggccauaaugagccagccaaccgcgggcacgacgcugugguccccacguacacuucccaguacacaccuaaacucggacagauucaaaucgguaccuggcagacugaugaccuuacagugaaucagccagucaaguucacccccgugggccugaacgauacggaacauuuuaaucaguggguugugccgcgauaugccggggcauugaaccuaaauaccaaccuggccccuucaguagcuccagucuuccccggagagagacuccuguuuuucaggagcuacauuccucuuaaaggcgguuaugggaaucccgcgaucgacugccuguugccacaagagugggugcagcacuuuuaccaggaagcagccccuaguaugucugagguugcucucgugcgguauaucaaccccgauacaggccgugcccuguucgaagcaaaguuacaccgcgccggauuuaugacugucuccagcaacaccucggcuccagugguagugccggccaauggcuacuucagauuugacucuuggguuaaccaguucuauucccuggcaccuauggggacaggaaaugguaggcggcgaguccaauga

SEQ ID NO: 19524 - RNA, 1629 nt, Artificial Sequence
  derived and/or modified sequence opt3 from capsid_protein__Norovirus__BAG34670
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuuccccgugucuauagaucagauguacaccagcccaaacgaggucaucuccgugcagugucagaacgguagaugcacacuugacggcgaacugcaagggucaacucaguugcagguuaguggaauuugugccuuuaagggcgaggugaccgcacaccuccaugauaaugaccaccuguauaacgucacaaucaccaauuuaaacgguagccccuucgacccuucugaagauauuccagcuccgcugggggugcccgacuuccagggaaggguauuuggcguuaucucccaacgggauaagcacaauucaccuggccauaacgagccagccaaucgcgggcacgacgcugugguccccacguacacuagccaguacacaccuaaacucggacagauacaaauugguaccuggcagacugaugaccuuacagugaaccagccagccaaguucacccccgucggccugaaugauacggaacauuuuaaccagugggugguuccgcgauaugcaggggccuugaaucuaaacaccaaucuggcuccuaguguggcgccaguauuccccggagagagacuccuguuuuucaggucuuacaucccucuuaaaggcgguuaugggaaccccgcaauugacugccuguugccacaagaguggguccagcacuuuuaccaggaagccgcuccuuccaugagcgagguggcccucguucgguauaucaaucccgauacaggccgugcacuguucgaagccaaguuacaccgcgcuggauuuaugacugugucgucuaacaccuccgccccagucgugguaccggcaaacggcuacuucagauuugacucaugggugaaucaguucuauagucuggcgccuauggggacaggaaacgguaggcggcgaguucaauga

SEQ ID NO: 19525 - RNA, 1623 nt, Artificial Sequence
  derived and/or modified sequence opt3 from capsid_protein__Norovirus__BAG55289
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcgauaccgcucauaggaaugagccccaacaguggguguugccgagcuacagugggcggaacaaucacaacguucaccucgcgccugcaguggccccaacauuucccggagaacagcuguuauucuuucguucuaccaugccuggcuguuccgguuaucccaauauggaccuggauugccuccuuccacaggaguggguacaauacuucuaucaggaagcugccccugcacagagcgacgucgcccuguugcgcuuugugaaccccgauacugggagaguucuauucgaguguaagcugcauaaaucgggcuacgugacggucgcucacacaggacagcaugaccucgugauuccaccgaacggcuauuuuagguucgacucuuggguaaaucaauucuacacccuggccccuauggggaacggaacuggucggcgacgcgcacuuuga

SEQ ID NO: 19526 - RNA, 1629 nt, Artificial Sequence
  derived and/or modified sequence opt3 from capsid_protein__Norovirus__BAG68707
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaauaucaccauuacgaacuuaaaugguucacccuucgacccuagugaagauaucccagcuccgcuggggguccccgacuuccagggaaggguguuuggcauaauuagccaacgggauaagcagaacgccacuggccacaaugagccugcuaaccgcgggcaugacguaguugugccaacauacaccgcccaguacacucccaaacucggacaaauccagauugguacauggcagaccgaugaccuuacggucaaucagccugcaaaguucaccccagugggccugaacgauacagaacacuuuaaucaaugggucgugccccgauaugccggggcuuugaaccuaaauacuaaccuggcgccgucuguugcaccuguguucccaggagagagacuccuguuuuucagguccuacaucccccuuaaaggcgguuaugggaauccugccaucgacugccuguugccccaggaguggguacagcauuuuuaccaggaagcugccccaucaaugagcgaggucgcacucgugcgguauauuaacccugauaccggccgugcccuguucgaagcuaaguuacaccgcgccggauuuaugacaguuaguucuaacacuuccgcacccguggucgugccagcgaauggcuacuucagauuugacagcuggguaaaccaauucuauucgcuggcuccgauggggaccggaaaugguaggcggcgagugcaguga

SEQ ID NO: 19527 - RNA, 1629 nt, Artificial Sequence
  derived and/or modified sequence opt3 from capsid_protein__Norovirus__BAG68708
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacagcaaaaugcguauuguggcgauguuauacaccccucugagauccaauggcucuggggaugacguguucacagucucgugcaggguucuuacccggccaucacccgauuuugacuucacuuauuuggugccgccuacaguagaaagcaagaccaaacccuuuacgcugccaauccuaacucucggagagcugaguaacucccgcuucccugugucuauagaucagauguacaccagccccaacgaggucaucuccgugcagugucagaaugguagaugcacacuugacggcgaacugcaagggacuacccaguugcagguuucaggaauuugugccuuuaagggcgaggugacagcacaccuccaugauaacgaccaccuguauaauaucaccauuacgaacuuaaaugguaguccauucgaccccagcgaagauaucccugcuccacugggggucccggacuuccagggaaggguguuuggcauaauuucucaacgggauaagcagaacgccacuggccacuccgagcccgcuaaucgcgggcaugacgccguaguuccuacauacaccgcacaguacacuccaaaacucggacaaauccagauugguacauggcagaccgaugaccuuacggugaaccagcccgucaaguucaccccugugggccugaaugauacagaacacuuuaaccaaugggucgugccacgauaugccggggcuuugaaucuaaacacuaaucuggcgcccucaguugcaccgguguucccuggagagagacuccuguuuuucaggagcuacaucccacuuaaaggcgguuaugggaaccccgccaucgacugccuguugccucaggaguggguacagcauuuuuaccaggaagcugcccccaguaugucugaggucgcacucgugcgguauauuaauccagauaccggccgugcccuguucgaagcuaaguuacaccgcgccggauuuaugacaguuuccagcaacacuucggcaccuguggucgcgcccgcuaacggcuacuucagauuugacucuugggugaaucaauucuauucccuggccccaauggggaccggaaacgguaggcggcgaguacaguga

SEQ ID NO: 19528 - RNA, 1629 nt, Artificial Sequence
  derived and/or modified sequence opt3 from capsid_protein__Norovirus__BAG68709
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaauaucaccauuacgaacuuaaaugguucacccuucgacccuagugaagauaucccagcuccgcuggggguccccgacuuccagggaaggguguuuggcauaauuagccaacgggauaagcagaacgccacuggccacaaugagccugcuaaccgcgggcaugacgccguaguuccaacauacaccgcacaguacacucccaaacucggacaaauccagauugguacauggcagaccgaugaccuuacggugaaucagccugucaaguucaccccagugggccugaacgauacagaacacuuuaaucaaugggucgugccccgauaugccggggcuuugaaccuaaauacuaaccuggcgccgucuguugcaccuguguucccaggagagagacuccuguuuuucagguccuacaucccccuuaaaggcgguuaugggaauccugccaucgacugccuguugccccaggaguggguacagcauuuuuaccaggaagcugccccaucaaugagcgaggucgcacucgugcgguauauuaacccugauaccggccgugcccuguucgaagcuaaguuacaccgcgccggauuuaugacaguuaguucuaacacuuccgcacccguggucgugccagcgaauggcuacuucagauuugacagcuggguaaaccaauucuauucgcuggcuccgauggggaccggaaaugguaggcggcgagugcaguga

SEQ ID NO: 19529 - RNA, 1629 nt, Artificial Sequence
  derived and/or modified sequence opt3 from capsid_protein__Norovirus__BAG68711
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaaugucaccaucacgaacuuaaaugguucacccuucgacccuagugaagauauuccagcuccgcugggggugcccgacuuccagggaaggguauuuggcguuaucagccaacgggauaagcacauagccucuggccauaacgagccugcuaaucgcgggcacgacgccguggucccaacuuacacagcacaguacacccccaaacucggacagauucaaaucgguacuuggcagacagaugaccuuaccgugaaccagccugucaaguucacgccagugggccugaaugauaccgaccauuuuaaccaguggguugugccccgauaugccggggcuuugaaucuaaacacaaaucuggcgccguccguagcaccugucuucccaggagaaagacuccuguuuuucaggucauacauuccccuuaaaggcgguuaugggaacccugccaucgauugccuguugccccaagagugggugcagcacuuuuaccaggagagcgcuccaaguaugucugaaguugcccucgugcgguauaucaauccugacacuggccgugcacuguucgaggccaaguuacaccgcgcuggauuuaugaccgucuccagcaacacaucggcccccgugguagugccagcaaacggcuacuucagauuugauucuuggguuaaucaguucuauucccuggcgccgauggggacuggaaacgguaggcggcgaacccaauga

SEQ ID NO: 19530 - RNA, 1629 nt, Artificial Sequence
  derived and/or modified sequence opt3 from capsid_protein__Norovirus__BAG68712
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaaugucaccaucacgaacuuaaaugguucacccuucgacccuagugaagauauuccagcuccgcugggggugcccgacuuccagggaaggguauuuggcguuaucagccaacgggauaagcacaacgccucuggccauaaugagccugcuaaccgcgggcacgacgccguggucccaacuuacacagcacaguacacccccaaacucggacagauacaaauugguacuuggcagacagaugaccuuaccgugaaucagccugucaaguucacgccagugggccugaacgauaccgaacauuuuaaucaguggguugugccccgauaugccggggcuuugaaccuaaauacaaaccuggcgccguccguagcaccugucuucccaggagagagacuccuguuuuucaggucauacaucccccuuaaaggcgguuaugggaauccugccauugacugccuguugccccaagagugggugcagcacuuuuaccaggaagcugccccaagcaugagugagguugcacucgugcgguauaucaacccugauacuggccgugcccuguucgaagcuaaguuacaccgcgccggauuuaugaccgucucuuccaacacaagcgcacccgugguagugccagcgaauggcuacuucagauuugacucguggguuaaccaguucuauucucuggcuccgauggggacuggaaaugguaggcggcgaguccaauga

SEQ ID NO: 19531 - RNA, 1629 nt, Artificial Sequence; identical to SEQ ID NO: 19530
  derived and/or modified sequence opt3 from capsid_protein__Norovirus__BAG68713

SEQ ID NO: 19532 - RNA, 1629 nt, Artificial Sequence
  derived and/or modified sequence opt3 from capsid_protein__Norovirus__BAG68714
augaagauggccagcaacgacgcugcacccuccaccgauggcgccgcggggcuggugccugagucuucaaaugaagucauggcucucgagccaguugccggagcagcccuugcugcaccggugacaggucagacuaacaucauugaccccuggauaagagccaauuucguacaagcuccuaacggcgaauuuacggugaguccaaggaaugcccccggggagguccuguugaacuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuuccccgugucuauagaucagauguacaccagcccaaacgaggucaucuccgugcagugucagaacgguagaugcacacuugacggcgaacugcaagggacuacccaguugcagguuucaggaauuugugccuuuaagggcgaggugacagcacaccuccaugauaaugaccaccuguauaacgucaccaucacgaauuuaaacgguagucccuucgacccuagcgaagauauuccagcuccgcugggggugcccgacuuccagggaaggguauuuggcguuaucucucaacgggauaagcacaaugccuccggccauaacgagccugcuaaucgcgggcacgacgccguggucccaacuuacacagcacaguacacccccaaacucggacaggugcaaauagguacuuggcagacagaugaccuuaccgucaaccagccugugaaguucacgccaguuggccugaaugauaccgaacauuuuaaccagugggugguaccccgauaugccggggcuuugaaucuaaacacaaaucuggcgccgucagucgcaccuguguucccaggagagagacuccuguuuuucaggagcuacauuccccuuaaaggcgguuaugggaacccugccaucgacugccuguugccccaagaguggguucagcacuuuuaccaggaagcugccccaaguaugucugagguggcacucguccgguauauuaauccugauacuggccgugcccuguucgaagcuaaguuacaccgcgccggauuuaugaccguguccagcaacacaucggcacccguagugguuccagcgaacggcuacuucagauuugacucuugggucaaucaguucuauucccuggcuccgauggggacuggaaacgguaggcggcgagugcaauga

SEQ ID NO: 19533 - RNA, 1629 nt, Artificial Sequence
  derived and/or modified sequence opt3 from capsid_protein__Norovirus__BAG68715
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaaugucaccaucacgaacuuaaaugguucacccuucgacccuagugaagauauuccagcuccgcugggggugcccgacuuccagggaaggguauuuggcguuaucagccaacgggauaagcacaacucuccuggccauaaugagccagccaaccgcgggcacgacgcugugguccccacuuacacagcccaguacaccccuaaacucggacagauacaaauugguacuuggcagacagaugaccuuaccgugaaucagccagucaaguucacgcccgugggccugaacgauaccgaacauuuuaaucaguggguugugccgcgauaugcaggggccuugaaccuaaauacaaaccuggcuccuuccguagcgccagucuuccccggagagagacuccuguuuuucaggucauacaucccucuuaaaggcgguuaugggaaucccgcaauugacugccuguugccacaagagugggugcagcacuuuuaccaggaagccgcuccuagcaugagugagguugcccucgugcgguauaucaaccccgauacuggccgugcacuguucgaagccaaguuacaccgcgcuggauuuaugaccgucucuuccaacacaagcgccccagugguagugccggcaaauggcuacuucagauuugacucguggguuaaccaguucuauucucuggcgccuauggggacuggaaaugguaggcggcgaguccaauga

SEQ ID NO: 19534 - RNA, 1629 nt, Artificial Sequence; identical to SEQ ID NO: 18054
  derived and/or modified sequence opt3 from capsid_protein__Norovirus__BAG68716

SEQ ID NO: 19535 - RNA, 1647 nt, Artificial Sequence
  derived and/or modified sequence opt3 from capsid_protein__Norovirus__BAG68799
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugauugccaugcuguacacuccccucagagcaaauaacucuggagaugacguuuucacagugucguguagggucuuaacucggccuucaccagauuuuagcuucaauuuucuggugcccccgaccguggagaguaagacaaaaccuuucucccuucccaucuugaccauaucugaaaugagcaacucccgcuuuccagucccuauugacucacugcauaccagucccacagagaauaucguugugcagugccagaacgguagaguaacccuagauggcgagcucauggggacgacucaacugcuuccaagccagauuugugcuuucaggggagugcugacccggucuacaucccgcgccucagaccaggcugauacugccacaccccgauuguucaauuauuacuggcacauccagcucgacaaccugaauggcaccccuuaugacccagcagaagauaucccgggucccuuagggaccccugacuuuagaggaaaggucuucggcguggccagccaaaggaacccagaugcuacgacucgggcgcaugaggcaaaaauugacacagccaguggccguuuuacccccaagcuggggucucucgaaauauccacugagagcgaugacuucgaucagaauaagccuacacgcuuuaccccaguuggaaucgguguggaccacgaagaggauuuccagcaauggacgcuucccgacuacgcuggccaguuuacccacaacaugaaucuggccccggcagucgccccuaacuucccaggggagcaguugcuauuuuucagaucgcagcugcccucuuccggaggcaggucaaaugguauucucgauugccuggugccucaagaauggguacagcauuuuuaccaggagagugcucccagccagucccaaguugcccuugugcgguauaucaacccagacacagggcgaguccuguucgaagcaaaauugcacaagcucggcuuuaugacuauagcgaaaaacggagacucuccuauuaccgugcccccaaauggcuacuuccgcuucgagagcugggucaacccguuuuauacacuggcuccuauggggacuggaaaugguagaaggcggauccaguga

SEQ ID NO: 19536 - RNA, 1647 nt, Artificial Sequence
  derived and/or modified sequence opt3 from capsid_protein__Norovirus__BAG68800
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaccuucuuucacuauaaccaggggagcgacucccgacuccgucugauugccaugcuguacacaccccucagagcaaacaauucuggagaugacguuuucacugugucguguagggucuuaacccggccuucaccagauuuuagcuucaacuuucuggugcccccgacaguggagaguaagaccaaaccuuucucccuucccaucuugacuauaucugaaaugagcaauucccgcuuuccagucccuauugacucacugcauacaagucccaccgagaacaucguugugcagugccagaaugguagaguaacgcuagauggcgagcucauggggacuacccaacugcuuccaagccagauuugugcuuucaggggagugcugacacggucuacuucccgcgccucagaccaggcugauaccgccacaccccgauuguucgacuauuacuggcacauccagcucgacaaccugaauggcaccccuuaugauccagcagaagacaucccgggucccuuagggacgccugauuuuagaggaaaggucuucggcguggccagccaaaggaacccagacacuacaacccgggcucaugaggcgaaaauugauacugcaaguggccguuuuacacccaagcuggggucucucgaaauauccaccgagagcgacgauuucgaccagaauaagccuacgcgcuuuaccccaguuggaaucgguguggaucacgaagaggacuuccagcaauggacacuucccaacuacgccggccaguuuacucacaauaugaaccuggcuccggccgucgcaccuaauuucccaggggaacagguguuguuuuucagaucgcagcuacccucuuccggaggcaggucaaacgguauucuggauugccucguaccucaagaguggguucagcauuuuuaccaggagagugcccccagccagucccaaguggcucugguccgguaugugaauccagacaccgggcgaguccuuuucgaagccaaacugcacaaguugggcuuuaugacaaucgcacgcaacggagacucuccuauaacugugcccccaaacggcuacuucagauucgagagcuggguuaauccguuuuauacccucgcgccuauggggacaggaaacgguaggcggcgcauucaguga

SEQ ID NO: 19537 - RNA, 1623 nt, Artificial Sequence; identical to SEQ ID NO: 18128
  derived and/or modified sequence opt3 from capsid_protein__Norovirus__BAG68801

SEQ ID NO: 19538 - RNA, 1623 nt, Artificial Sequence
  derived and/or modified sequence opt3 from capsid_protein__Norovirus__BAG68802
augaagauggccagcaacgacgcuacccccuccgauggcucuacagcaaaucuggugccugaggucaacaaugaaguuauggcccucgagccaguggcgggggcugccaucgcagccccgguagcuggacagcaaaacgugauugaccccuggauaagaaauaacuucguccaggcaccugguggcgaauuuacugugucaccaaggaaugcccccggggagauccuuuggagugcuccucugggaccagauuugaaccccuacuuaagccaccuggcccggauguauaauggcuacgcggguggguucgaaguucaggugauucuagcaggaaacgccuuuacggcuggcaaaaucauuuucgccgcagucccuccaaauuuuccgaccgagggccucucccccucucaggugacaauguucccucauaucauaguagacguucgccaacuggagccagugcuuaucccccugccugauguccgaaacaauuuuuaucacuacaaccagucgaaugacccaacuauuaaguugaucgcuaugcucuauacgccccugcgugccaacaacgcgggggaugacguguucacagugucaugcagaguccugaccaggccgagcccugauuuugacuucauuuuucucguucccccaacuguggaaagucggacaaaaccuuucuccguacccaucuuaaccguggaggaaaugaccaauucucgcuuuccaauaccccuggagaaacuuuucacuggaccuagcuccgccuucgucgugcagccacagaacgguagauguaccacagauggcguuuugcuggggacuacccaacuaucaccggugaauauuugcacauuuaggggagacgucacccauaucgcaaacacgcagaauuacacuaugaaccucgcuagucagaauuggaacaauuaugaucccacagaggaaauuccugccccacugggcacccccgacuucgugggucggauccaggggguacuuacucaaacaacccgcggagacggcagcacgcgaggccacaaggcuaccguuucuacaggguccgugcauuuuacuccuaagcugggaucaguccaguucagcaccgauacaaguaacgacuuggagacuggucagaauaccagauuuacaccagugggcgucgugcaagaugggggaaccacucacaggaacgaaccccagcaguggguucucccggacuacucuggccgggauucccacaaugugcaucuggccccugcaguagccccaacguuccccggugagcaguuacuguuuuuccguagcacaaugccuggguguucgggcuaccccaacaugaaucucgacugccuucugccacaagaauggguccagcacuuuuaucaggagucugcuccugcgcaguccgauguggcauugcuacgcuucguuaaccccgacaccggaagagugcuguuugaguguaagcuccauaaaucaggcuacgucacuguggcccacaccgggcaacacgaucugguaaucccaccgaacggauauuucagguuugacaguugggugaaucaguucuacacacuugcuccuauggguaacggcgccgggcggcgacgcgcacuguga

SEQ ID NO: 19539 - RNA, 1623 nt, Artificial Sequence
  derived and/or modified sequence opt3 from capsid_protein__Norovirus__BAG68803
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaaggaagacggcagcacacgcgggcacaaggcuaccguguacacgggaucugcccccuuuaccccuaaauuggguuccguccaguucucaacagacacugagaacgauuuugaaacccaucaaaauacaaaguucacuccagugggcgucauccaggacgggagcaccacacaccgaaacgagccccagcaaugggugcucccgaguuacucuggaagaaauguucacaacgugcaucuggccccugcaguagcuccaaccuuucccggcgagcaguuacuguucuuuagguccacuaugccugguuguagcggguaucccaauauggaucucgacugccuucugccacaggaauggguccagcacuucuaccaagaggcggccccugcacagucggauguggcuuugcuacgguuuguuaaccccgacacgggccgugugcuguucgaauguaaacuccauaagucuggauaugucacaguggcccacaccggccagcacgaucugguaauuccaccgaacggguacuuucgcuucgacuccugggugaaucaguucuauacucuugcaccuaugggaaacgguaccggcagaaggcgggcccuguga

SEQ ID NO: 19540 - RNA, 1623 nt, Artificial Sequence; identical to SEQ ID NO: 18112
  derived and/or modified sequence opt3 from capsid_protein__Norovirus__BAG68804

SEQ ID NO: 19541 - RNA, 1623 nt, Artificial Sequence
  derived and/or modified sequence opt3 from capsid_protein__Norovirus__BAG68805
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucguguucgcugccguaccuccaaauuuuccgacggagggccucucgcccucacagguuaccauguucccucauauuaucguggacguccgccaacuggagccagugcuuauaccccugccugaugugcgaaacaauuuuuaucacuacaaccagagcaaugacccaacaaucaaguugauugcaaugcucuauacuccccugcgugcuaacaacgccggcgaugacgucuucaccguuaguugcagagugcugacaaggccguccccugauuuugacuucaucuuucucguacccccaaccguggaaucucggacuaaaccuuucagcguccccauuuuaacaguggaggaaaugaccaauucccgcuuuccaaucccccuggagagacuuuucacggggccuucaagugcguucguugugcagccacagaacggaagguguacuaccgauggugucuugcugggcacaacucaacuaagcccggugaauauaugcaccuuucgcggggacguaacacauauugccggaacccaggaguacacgaugaaccucgcaucucagaauuggaacaauuaugaucccacugaagagguuccugcuccacugggcacacccgacuucauggguaagauccagggggugcuuacccaaacuacacggcgagacggauccaccagaggccacaaagccacggucucaaccggcagcgugcauuuuacaccuaagcuggggaggauucaguucaguacugauaccucuaacgacuuugaaacaggacagaauacucgguucaccccagucggugugguucaagauggcuccacaacccaccagaacgagccccagcaguggguguugccgaauuacagcgggcgugacucgcacaacguacaucucgcuccugccgucgcaccaucuuuucccggagaacaacuguuauucuuucgcuccacuaugccuggcuguucagguuaccccaauaugaaccuggauugccuccuuccacaggagugggugcagcacuucuaucaggaggccgcuccugcgcaaagugacguugcacuguugagauuugugagccccgauacggggaggguccuauucgaauguaagcugcauaaauccggcuacgugacaguagcccacaccggacagcacgaccucgugaucccaccgaauggcuauuuucgguucgauucuuggguuaaccaguucuacacucuggcuccuauggggaacggaaccggucgacgcagagcccuuuga

SEQ ID NO: 19542 - RNA, 1623 nt, Artificial Sequence
  derived and/or modified sequence opt3 from capsid_protein__Norovirus__BAG68806
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucguguucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacagcacaaucaaguugauugcaaugcucuauacuccacugcgugcuaacaacgccggggaugacgucuucaccguuaguugcagagugcugacaaggcccuccccggauuuugacuucaucuuucucguaccucccaccguggaaucucggacuaaaccauucagcgucccuauuuuaacaguggaggaaaugaccaauucccgcuuucccaucccacuggagaaacuuuucacgggacccucaagugcguucauaguucagccucagaacgguagauguacuaccgauggcguguugcuggggacaacucaacuaagcccagucaauauuugcaccuuuaggggagacgugacacauaucgccggcacccaggaguacacgaugaaccucgcaucucagaauuggaacaauuaugauccgacugaagagauucccgcuccucuggguacaccagacuucguagggaagauccagggaguucuuacccaaacuacacggcgcgacggcuccacccgaggccacaaggccacggugucaaccgggagcguccauuuuacacccaagcugggaagaauccaguucaguacugauaccucuaacgacuuugaaacaggucagaauacuagguucaccccugugggcgucgugcaagauggguccacaacccaccagaacgagccacagcaguggguuuugcccaauuaccucggacgggacagccacaacgugcaucuggcuccggccguagcaccuucguuuccaggcgaacaauuacuguucuuucguucuacuaugcccgguuguuccggguacccuaauaugaaccucgauugccuucugccccaggaguggguccagcacuucuaucaggaggccgcuccagcgcaaucagacguggcauugcuacgcuuuguuaauccugauacgggcagagugcuguucgaauguaaacuccauaagaguggauacgucacaguggcccacaccggccagcacgaccugguaauucccccaaacggguauuuuagguucgauagcugggugaaccaguucuacacucuugcuccgaugggaaaugguaccggccggcgacgcgcccuguga

SEQ ID NO: 19543 - RNA, 1647 nt, Artificial Sequence
  derived and/or modified sequence opt3 from capsid_protein__Norovirus__BAG68807
augaagauggccagcuccgacgcuacccccucuaacgauggcgcagccgggcuggugccugagaucaauaacgaagcgauggcucucgacccagucgccggagcagccauugcugcaccgcuuacaggucagcaaaauauaaucgaucccuggauuaugaacaauuucguucaggccccuggcggggaguuuacugugucaccaagaaacagucccggagaaguacuguugaauuuagagcugggcccugaaaucaacccauaccuagcucaccucgccaggauguauaaugguuacgcagggggauucgaggugcaggucgugcuggcgggcaacgccuuuacggcuggcaaaauuaucuucgccgcaauacccccuaauuuuccaaucgacaaccuuagcgcugcccagauuaccaugugcccgcauguuaucguggauguccggcaacuggagcccgugaauuugccuaugccagacguacgcaacaauuucuuucacuauaaccagggguccgauucucgacuccgucugauugcgaugcuguacacaccccucagagccaacaauucgggagacgauguuuucacugugucauguagggucuuaacccggccuagcccagacuuuaguuucaacuuucuggugcccccgacaguggaauccaagaccaaaccuuucacucuucccaucuugacaauaucugagaugagcaauucccgcuuuccagucccuauugauucacugcauaccagucccacggaaaacaucguugugcagugccagaaugguagaguaacucuagacggcgagcucauggggaccacacaacugcuuccaagccagauuugugcauucaggggagugcugacucggucuaccucccgcgcuucagaucaggccgacacagcuacgccccgauuguucaacuauuacuggcacauccagcucgacaaucugaacggcaccccuuaugauccagccgaggacaucccgggucccuuagggacuccugauuuuagaggaaaggucuucggcguggcaagccaaaggaauccagacaguacaacccgggcccaugaagcuaaaguugauacuacagcgggccguuuuacccccaagcuggggucucucgagauuuccacggaaagcgacgauuucgaccagaaccagccuacccgcuuuacaccagugggaauaggugucgaucacgaggcagacuuccaacaguggucgcuucccgauuacucuggccaguuuacucacaauaugaaccuggccccggcuguggccccuaauuucccaggggaacaguugcuauuuuucagaucccaacugcccucaaguggaggcaggagcaacgguauccucgacugccugguaccucaggaguggguucagcauuuuuaccaggaguccgcacccgcccaaacccagguggcucuuguccgguaugugaauccagacacagggcgaguccuguucgaagccaaguugcacaaacucggcuuuaugacuauugcaaagaacggagauucuccuaucaccgugcccccaaacggcuacuuccgcuucgagagcuggguuaauccguuuuauacacuggcgccuauggggaccggaaacgguagaaggcggauacaguga

SEQ ID NO: 19544 - RNA, 1623 nt, Artificial Sequence
  derived and/or modified sequence opt3 from capsid_protein__Norovirus__BAG68808
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagauucaugcagaguccugaccaggccgagcccugacuuugauuucauuuuucucguucccccaacuguggaaagucggacaaaaccuuucuccguacccaucuuaaccguggaggaaaugaccaauucucgcuuuccaauaccccuggagaaacuuuucacuggaccuagcuccgcguucgucgugcagccacagaacgguagauguaccacagacggcguuuugcuggggacuacccaacuaucaccggugaauauuugcacauuuaggggagaugucacccauaucgccggcacgcagaacuacacuaugaaucucgcaagucagaacuggaauaacuaugaccccacagaggaaauuccugcuccacuggguacccccgacuucguggggaagauccagggaguacuuacucaaacaacccggcgcgauggcagcacgcgaggccacaaggccaccguuucuacaggguccgugcauuuuacuccuaagcugggaucaguccaguucagcaccgacacaaguaaugauuuggagacuggucagaacaccagauuuacaccagugggcgucgugcaagacgggucuaccacucaccagaaugaaccccagcaguggguucucccggauuacuccggaagggacagccacaacgugcaucuggcuccugccguagcaccaacguuccccggcgagcaauuacuguuuuuccggucgacaaugccugguuguucuggguaccccaauaugaaccucgauugccuucugccacaggaauggguccagcacuuuuaucaggaguccgccccugcucaaucagacguggcguugcuacguuucguuaaucccgauaccggccgcgugcuguuugaguguaaacuccauaagaguggauacgucacuguggcacacaccggccagcacgaccugguaaucccaccgaacggguauuucagauuugauagcugggugaaccaguucuacacacuugccccuaugggaaauggugcuggcaggcggcgagcccuguga

SEQ ID NO: 19545 - RNA, 1623 nt, Artificial Sequence
  derived and/or modified sequence opt3 from capsid_protein__Norovirus__BAG68809
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagauucaugcagaguccugaccaggccgagcccugacuuugauuucauuuuucucguucccccaacuguggaaagucggacaaaaccuuucuccguacccaucuuaaccguggaggaaaugaccaauucucgcuuuccaauaccccuggagaaacuuuucacuggaccuagcuccgcguucgucgugcagccacagaacgguagauguaccacagacggcguuuugcuggggacuacccaacuaucaccggugaauauuugcacauuuaggggagaugucacccauaucgccggcacgcagaacuacacuaugaaucucgcaagucagaacuggaauaacuaugaccccacagaggaaauuccugcuccacuggguacccccgacuucguggggaagauccagggaguacuuacucaaacaacccggggcgauggcagcacgcgcgggcacaaggccaccguuucuacaggauccgugcauuuuacuccuaagcuggguucaguccaguucagcaccgacacaaguaaugauuuggagacuggccagaacacccgauuuacaccagugggggucgugcaagacggaucuaccacucaccagaaugaaccccagcaguggguucucccgaacuacuccggcagagauagccacaaugugcaucuggcuccugccguagcaccaacguuccccggugagcaauuacuguuuuucaggucgacaaugccuggguguucuggcuaccccaacaugaaucucgacugccuucugccacaggaauggguccagcacuuuuaucaggaguccgccccugcucaaucagauguggcguugcuacgguucguuaaccccgacaccggacgugugcuguuugaguguaaacuccauaagaguggcuacgucacuguggcacacaccgggcagcacgaucugguaaucccaccgaacggauauuuccgcuuugacagcugggugaaucaguucuacacacuugccccuauggguaacggcgcugggagaaggcgggcccuguga

SEQ ID NO: 19546 - RNA, 1623 nt, Artificial Sequence
  derived and/or modified sequence opt3 from capsid_protein__Norovirus__BAG68810
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguagguaagauccaggggguucuuacccaaacuacacggcgcgacggauccacccgaggccacaaggccacggugucaaccggcagcguccauuuuacaccuaagcuggggagaauccaguucaguacugauaccucuaacgacuuugaaacaggacagaauacuagguucaccccagugggugucgugcaagauggcuccacaacccaccagaacgagccccagcaguggguuuugccgaauuacagcgggcgggacggacacaacgugcaucucgcuccugccguagcaccaucguuucccggcgaacaacuguuauucuuucguucuacuaugccugguuguuccggguaccccaauaugaaccuggauugccuccuuccacaggaguggguccagcacuucuaucaggaggccgcuccugcgcaaucagacguggcacuguugcgcuuuguuaaucccgauacgggcagagugcuauucgaauguaaacugcauaagaguggauacgucacaguggcccacaccggccagcacgaccucguaauuccaccgaacggguauuuuagguucgauagcugggugaaccaguucuacacucuggcuccuaugggaaaugguaccggccggcgacgcgcccuuuga

SEQ ID NO: 19547 - RNA, 1623 nt, Artificial Sequence
  derived and/or modified sequence opt3 from capsid_protein__Norovirus__BAG68811
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccaacacccaggaguacacgaugaaucucgcaucucagaacuggaauaacuaugaucccacugaagagauuccugcuccacuggggacacccgacuucguaggcaagauccaggguguucuuacccaaacuacacggcgcgacggguccacccgaggacacaaggccacggugucaaccggcagcguccauuuuacaccuaagcugggcagaauccaguucaguacugauaccucuaaugacuuugaaacagggcagaacacuagguucaccccagugggagucgugcaagaugguuccacaacccaccagaaugagccccagcaguggguuuugccgaacuacagcggcggggacggacacaaugugcaucucgcuccugccguagcaccaucguuucccggcgaacaacuguuauucuuucggucuacuaugccugguuguuccggguaccccaacaugaaucuggauugccuccuuccacaggaguggguccagcacuucuaucaggaggccgcuccugcgcaaucagacguggcacuguugcguuuuguuaaccccgauacgggccgcgugcuauucgaauguaaacugcauaagaguggauacgucacaguggcccacaccggccagcacgaccucguaauuccaccgaacggguauuuuagauucgauagcugggugaaucaguucuacacucuggcuccuaugggaaacgguaccggcaggcggcgagcccuuuga

SEQ ID NO: 19548 - RNA, 1623 nt, Artificial Sequence; identical to SEQ ID NO: 18675
  derived and/or modified sequence opt3 from capsid_protein__Norovirus__BAG68812

SEQ ID NO: 19549 - RNA, 1623 nt, Artificial Sequence
  derived and/or modified sequence opt3 from capsid_protein__Norovirus__BAG68813
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccugucucggauguauaauucguacgcuggcgguuucgaagugcaggucauucuagccgggaacgcguuuacugcaggaaaaaucauuuucgccgcugugccuccaaauuuuccgaucgagggccucucacccagccagguaacgauguucccucauauaaucguugacgugcgccaacuggagccaguccuuauuccccugccugaugugcgaaacaauuuuuaucacuacaaccagaguaaugacccaaccaucaaguugauugccaugcucuauacaccccugcgugcaaacaacgcuggcgaugacguguucacugucuccugcagaguucugaccaggccgucuccugauuuugacuucaucuuucucgugcccccaacaguagaaagccggaccaaaccuuucuccgugcccauauuaacugucgaggaaaugacaaauucacgcuuuccaacccccguggagaagcuguucacggggccuaguagcgccuucauuguucagccacagaacggaagauguacuaucgauggugugcuuuugggcaccacacaacugucuccggucaauauuugcacuuuuaggggagacgugacccauaucgcggggacacaggaguacaccaugaaccuagccucccagaauuggaacaauuaugaucccacggaagagaucccugcaccacucggcacucccgacuucguagguaaaauucaggggguucugacacaaaccacucggcgcgacggaucaacacgaggccacaaggcuaccgugagcacgggcaguguccauuuuaccccuaaacuugggagaauacaguucucuacagauacuuccaacgacuuugaaaccaggcagaauacacgguucacuccagugggagucauccaagaugguagcaccacacaccagaacgagccccagcagugggugcugccgaauuacucgggccgugacucucacaacguucauuuggccccugcuguggccccauccuuucccggggaacaacuccuguucuuucgcucaaccaugccuggauguaguggcuaccccaauaugaacuuagauugccugcucccacaggaguggguacagcacuucuaucaggaggcagccccugcucaaagcgacgucgcgcuucugagauuugugaaucccgauacugguaggguuauguucgaauguaaguugcauaaguccggguacauuacgguggcacacacaggccagcacgaccuagucaucccaccgaacggauauuuucgguucgaugccugggugaaccaguucuacacccuggcuccuaugggcaaugggacuggacgacgcagagcccucuga

SEQ ID NO: 19550 - RNA, 1647 nt, Artificial Sequence
  derived and/or modified sequence opt3 from capsid_protein__Norovirus__BAG68814
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugauugccaugcuguacacuccccucagagcaaauaacucuggagaugacguuuucacagugucguguagggucuuaacucggccuucaccagauuuuagcuucaauuuucuggugcccccgaccguggagaguaagacaaaaccuuucucccuucccaucuugaccauaucugaaaugagcaacucccgcuuuccagucccuauugacucacugcauaccagucccacagagaauaucguugugcagugccagaacgguagaguaacccuagauggcgagcucauggggacgacucaacugcuuccaagccagauuugugcuuucaggggagugcugacccggucuacaucccgcgccucagaccaggcugauacugccacuccccgauuguucaauuauuacuggcacauccagcucgacaaccugaauggcacaccuuaugacccagcagaagauaucccgggucccuuagggaccccugacuuuagaggaaaggucuucggcguggccagccaaaggaacccagauacgacuacacgggcucaugaggcgaaaauugacaccaccaguggccguuuuacacccaagcuggggucucucgaaauauccaccgagagcgaugacuucgaucagaauaagccuacgcgcuuuaccccaguuggaaucgguguggacagagaagucgauuuccagcaaugggcacuucccgacuacgccggccaguuuacacacaacaugaaucuggcuccggccguggcaccuaacuucccaggggagcaguugcuauuuuucaggucgcagcugcccucuuccggaggccggucaaaugguauucucgauugccugguaccucaagaguggguucagcacuuuuaccaggaaagugcccccagccagucccaaguggcucuuguccgauauaucaacccagacacugggcgcgugcuguucgaggccaaauugcauaagcucggcuuuaugaccauagcgaaaaacggagacucuccuauuacagugcccccaaauggcuacuucagauucgaaagcugggucaacccguuuuauacucuggcaccuauggggaccggaaaugguaggcggcgcauccaguga

SEQ ID NO: 19551 - RNA, 1647 nt, Artificial Sequence
  derived and/or modified sequence opt3 from capsid_protein__Norovirus__BAG68815
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugauugccaugcuguacacuccccucagagcaaauaacucuggagaugacguuuucacagugucguguagggucuuaacucggccuucaccagauuuuagcuucaauuuucuggugcccccgaccguggagaguaagacaaaaccuuucucccuucccaucuugaccauaucugaaaugagcaacucccgcuuuccagucccuauugacucacugcauaccagucccacagagaauaucguugugcagugccagaacgguagaguaacccuagauggcgagcucauggggacgacucaacugcuuccaagccagauuugugcuuucaggggagugcugacccggucuacaucccgcgccucagaccaggcugauacugccacuccccgauuguucaauuauuacuggcacauccagcucgacaaccugaauggcacaccuuaugacccagcagaagauaucccgggucccuuagggaccccugacuuuagaggaaaggucuucggcguggccagccaaaggaacccagauacgacuacacgggcucaugaggcgaaaauugacaccaccaguggccguuuuacacccaagcuggggucucucgaaauauccaccgagagcgaugacuucgaucagaauaagccuacgcgcuuuaccccaguuggaaucgguguggaccacgaagucgauuuccagcaaugggcacuucccgacuacgccggccaguuuacacacaacaugaaucuggcuccggccguggcaccuaacuucccaggggagcaguugcuauuuuucagaucgcagcugcccucuuccggaggcaggucaaaugguauucucgauugccugguaccucaagaguggguucagcauuuuuaccaggaaagugcccccagccagucccaaguggcucuuguccgguauaucaacccagacacugggcgagugcuguucgaggccaaauugcacaagcucggcuuuaugaccauagcgaaaaacggagacucuccuauuacagugcccccaaauggcuacuuccgcuucgaaagcugggucaacccguuuuauacucuggcaccuauggggaccggaaaugguagaaggcggauccaguga

SEQ ID NO: 19552 - RNA, 1623 nt, Artificial Sequence
  derived and/or modified sequence opt3 from capsid_protein__Norovirus__BAG68816
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaugaucguugacgugcgccaacuggagccaguccuuauaccccugccugaugugcgaaacaauuuuuaucacuacaaccagucaaaugacccaacaaucaaguugauugcaaugcucuauacuccccugcgugcuaacaacgccggggaugacguguucaccgucagcugcagaguucugacaaggccgaguccugauuuugacuucaucuuucucgugcccccaaccguagaaucccggacuaaaccuuucucugugcccauuuuaacagucgaggaaaugaccaauagccgcuuuccaaucccccuggagaaacuuuucacgggaccuuccucagcguucgugguucagccacagaacgguagauguacuaccgauggcguguugcuggggacaacucaacuaaguccggucaauauaugcaccuuuaggggagacgugacacauauugccggcacccaggaguacacgaugaaccucgcaagccagaauuggaacaauuaugaucccacugaagagaucccugcuccacuggguacacccgacuucguagggaagauucagggaguucuuacccaaacuacacggggcgacggcucuacccgcgggcacaaggccacgguguccaccggaucaguccauuuuacaccuaagcugggucgaauccaguucagcacugauaccaguaacgacuuugaaacaggccagaauacuagauucaccccagugggggucgugcaagauggaucuacaacccaccagaacgagccccagcaguggguuuugccgaauuacuccggcagggacagccacaacgugcaucucgcuccugccguagcaccaucguuucccggugaacaacuguuauucuuucggucuacuaugccuggguguuccggcuaccccaauaugaaccuggauugccuccuuccacaggaguggguccagcacuucuaucaggaggccgcuccugcgcaaucagacguggcacuguugcguuuuguuaaucccgauacgggacgcgugcuauucgaauguaaacugcauaagaguggcuacgucacaguggcccacaccgggcagcacgaccucguaaucccaccgaacggauauuuuagauucgauagcugggugaaccaguucuacacucuggcuccuauggguaauggcaccgggaggcggcgagcccuuuga

SEQ ID NO: 19553 - RNA, 1626 nt, Artificial Sequence
  derived and/or modified sequence opt3 from capsid_protein__Norovirus__BAH04374
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguacuucagcccagacugugcacgcaugcaagguggccagcuccuauuuacggcuugcucguggaccccucccugccaucuaauccccaauggcagaacgggcggguccacguggauggaacuuuacugggcaccacaccuguuagcgguuccugggugucauguuucgccgcugaagccgcauaugaguuucagagugggacuggagaggucgccaccuucacacucaucgaacaagacggcagcgcuuacgugccaggcgaucgcgcggcaccgcuuggguaccccgacuuuucuggacagcuggagauugaaguacagaccgagacgacuaagaaaggugaaaaguugaagguuacaaccuucgagaugauccuaggcccuacuacaaauguggaccaggucccauaucaagggcgaguguacgccucccugaccgcugccgcaucacucgaucuggucgacggaagagugagggccguuccccggagcguguauggcuuccaggauguagucccugaguacaacgacggucuucuggugccauuggcucccccgauagggccuuuucucccaggcgaaguucuguuacguuuccgcacguauaugagacagauugauaguaccgacgccgcagcggaggcuaucgauugcgcccugccccaggaauuugugucuugguucgcauccaaugccuuuacaguccaaagcgaggcucuacuccugagguaccggaacacucuuaccggacaguugcuguucgaauguaaacucuauucggagggcuacauugcccugucuuacuccgggucaggaccucuuacauuucccacugacgguuucuuugaggugguaaguugggugccacgacuguaucaguuggcaagcguuggcucccucgcuaccgggcgcacacugaagcaguga

SEQ ID NO: 19554 - RNA, 1626 nt, Artificial Sequence
  derived and/or modified sequence opt3 from capsid_protein__Norovirus__BAH04377
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguacuucagcccagacugugcacgcaugcaagguggccagcuccuauuuacggcuugcucguggaccccucccugccaucuaauccccaauggcagaacgggcggguccacguggauggaacuuuacugggcaccacaccuguuagcgguuccugggugucauguuucgccgcugaagccgcauaugaguuucagagugggaucggagaggucgccacuuucacccucauugaacaagacggcagcgcuuacgugccaggcgaucgcgcggcaccgcuuggguaccccgacuuuucuggacagcuggagaucgaaguacagacagagaccacgaagaaaggugaaaaguugaagguuacuacauucgagaugauacuaggcccuaccacuaauguggaccaggucccauaucaagggcgaguguacgccucccugacagcugccgcaucacucgaucuggucgacggaagagugagggccguuccccggagcguguauggcuuccaggauguagucccugaguacaacgacggucuucuggugccauuggcucccccgauugggccuuuucucccaggcgaaguucuguuacguuuccgcaccuauaugagacagaucgauaguacggacgccgcagcggaggcuauugauugcgcccugccccaggaauuugugucuugguucgcauccaaugccuuuaccguccaaagcgaggcucuacuccugagguaccggaacacacuuacuggacaguugcuguucgaauguaaacucuauucggagggcuacaucgcccugucuuacuccgggucaggaccucuuaccuuucccacagacgguuucuuugaggugguaaguugggugccacgacuguaucaguuggcaagcguuggcucccucgcuacugggcgcacccugaagcaguga

SEQ ID NO: 19555 - RNA, 1623 nt, Artificial Sequence; identical to SEQ ID NO: 18815
  derived and/or modified sequence opt3 from capsid_protein__Norovirus__BAH29786

SEQ ID NO: 19556 - RNA, 1623 nt, Artificial Sequence
  derived and/or modified sequence opt3 from capsid_protein__Norovirus__BAH30707
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucaguggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcaauaccgcucauaggaacgagccccaacaguggguguugccgagcuacagugggcguaauucucacaacguucaccucgcgccugcaguggccccaacauuucccggagaacagcuguuauucuuucgguccaccaugccuggcuguagcgguuaucccaauauggaucuggacugccuccuuccacaggaguggguacaauacuucuaucaggaagcugccccugcacagucggaugucgcccuguugcgcuuugugaaccccgacacugggagaguucuauucgaguguaagcugcauaaaucuggcuacgugacggucgcucacacaggacagcaugaucucgugauuccaccgaacggcuauuuuagguucgacuccuggguaaaucaauucuacacccuggccccuauggggaacggaacuggucggcgacgcgcacuuuga

SEQ ID NO: 19557 - RNA, 1653 nt, Artificial Sequence
  derived and/or modified sequence opt3 from capsid_protein__Norovirus__BAL40869
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagauaacauuucugcugcccagaucacuaugugcccgcacguuauaguggacguccgccagcuugaacccgugcuguugccucucccagauauccgaaauagauuuuuccauuauaaccaggagaauacgccccguaugaggcugguggcaaugcuguacaccccucuccgggcuaacucgggcgaagacgucuuuacaguuucaugucgcguguuaacuagaccagcccccgauuucgaguuuaccuuccugguaccgccuacaguggagagcaagaccaaacccuuuacucuuccaauuuugacacugggcgaacuaaguaacuccagguucccugcggccaucgacaugcucuauaccgaucccaaugagucuauugucgugcaaccacagaacgggcggugcacgcuggacggaacucuucaggguaccacacagcugguucccacucaaaucugugcauuucgcggcaccuugauaagccagacagcucgagccguggauuccaccgacucaccucagagagcuagggaucacccacuccauguccaagugaagaaucuggacgggacgcaguacgacccgacugaugacauucccgccguauuaggagcaaucgauuucaaaggcacaguuuucgguguggccagucagcgggacgucagcgggacccaggaacaaggacacuaugcuacucgugcgcacgaggcacauauugauacaaccgacccuaaguacgccccaaagcugggcacgauccucaucaaaucugaaucccccgauuuuaacaccaaucagccuauucgcuucacaccagugggcaugggggacaacaauuggagacagugggagcuucccgauuacucaggaaggcugacuuugaacaugaaucuagcuccggccgucagcccuaguuuuccaggugagcggauacuguucuuucgaucuaucgugcccuccgcaggcggguauggaagcggcuacauugacugccucaucccucaggaauggguucaacacuucuaucaggaggccgcucccucgcagucugccguggcacugguacgcuacgucaacccagauaccgguagaaauauauuugaagcgaaacuucauagggagggguuccugacaguggcuaacuccggcaauaacccuauuguugugcccccaaauggauauuuucgguucgaagccugggucaaccaguuuuacacuuuggcaccgaugggcucagggcaaggacgcagaagggcccaguga

SEQ ID NO: 19558 - RNA, 1644 nt, Artificial Sequence
  derived and/or modified sequence opt3 from capsid_protein__Norovirus__BAL40870
augaagauggccagcuccgacgcugcacccucuaacgauggcgccgcgaaucuggugccugaggcuaacaaugaagucauggcccucgagccaguugugggggcaucaaucgccgcuccgguagugggacagcaaaacauuauagaccccuggaucagagaaaauuucguccaggcaccucagggugaguuuaccgugaguccaaggaacagccccggcgaaaugcuucugaauuuggaguuagggccugagcugaacccauaccuaucccaccucucucggauguauaauggauacgccggcgguaugcagguucaagugguccuggcugggaacgccuucacagcgggaaaaauuaucuuugcagccgugcccccucauuucccaguagaaaauauuucggcugcccagaucacuaugugcccgcacguuauaguggauguccgccagcuugagcccgugcuguugccucucccagacauccgaaacagauuuuuccauuauaaucaggaaaacacgccccguaugaggcugguggcaaugcuguacaccccucuccgggcuaauucaggcgaggaugucuuuacaguuagcugucgcguguuaacuagaccagcccccgacuucgaguuuaccuuccugguaccgccuacaguggaaaguaagaccaaacccuuuacucuuccaauuuugacacugggcgagcuauccaacucuagguucccugcgcccaucgauaugcucuauaccgacccaaacgaagggauugucgugcaaccccagaauggacggugcacgcuggaugguacucuucagggcaccacacagcugguuccuacucaaaucugugccuuucgcgggaccuugauaggacagacaagccgauccucagacaguaccgauagcgcaccaagaaggcgggaccacccgcuccaugugcagcugaagaacuuagauggcacgcaauacgaccccacugacgaggucccugcugugcugggugccauugauuucaaagggacaguauucggaguugcuucucagcgugacguguccggccagcaggucggcgccacccgcgcacacgaagugcacaucaauacuacagauccaagauauacccccaagcucgggucaauucuuaugcauagcgagagugacgauuuugucacgggacaaccugugagguucaccccaaucgguaugggcgacaacgauuggcaccagugggagcugcccgacuacucugggcauuugacacuaaauaugaaccuggccccggcuguugcgccugcauuuccaggagaacggauccucuucuuucgauccauugugcccagcgccggcgguuacgggucgggccagauagauugccugaucccucaggaguggguacaacacuucuaucaggaagcugcccccucucaguccgcagucgcccuuauucgcuacgugaauccagacacuggaagaaacaucuuugaggcuaagcugcacagggaaggcuucauaaccguugccaauucagggaacaauccuauuguggcacccccaaacggauauuuucgguucgaggcgugggucaaucaguuuuacacauugacuccgauggguaccggccaagggcgcagaaggaaccaguga

SEQ ID NO: 19559 - RNA, 1644 nt, Artificial Sequence
  derived and/or modified sequence opt3 from capsid_protein__Norovirus__BAL40871
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaugacgucuuuacaguuucaugucgcguguuaacuagaccagcccccgauuucgaguuuaccuuccugguaccgccuacaguggagagcaagaccaaacccuuuacucuuccaauuuugacacugggcgaacuaaguaacuccagguucccugcgcccaucgacaugcucuauaccgauccaaaugaggggauugucgugcaaccccagaacggacggugcacgcuggacgguacucuucagggcaccacacagcugguuccuacucaaaucugugccuuucgcgggaccuugauaggacagacaucucgaagcuccgauucaaccgacagugcaccaagaaggcgggaucacccgcuccaugugcagcugaagaauuuagacggcacgcaauacgaccccacugaugaagucccugcugugcugggugccauugacuucaaagggacaguauucggaguugcuagccagcgugaugugucuggccagcaggucggcgccacccgcgcacacgaggugcacaucaacacuacagacccaagauauacccccaagcucggguccauucuuaugcauucagaaagcgaugacuuugucacgggacaaccugugagguucaccccaaucgguaugggcgauaaugacuggcaccagugggagcugcccgauuacagugggcauuugacacuaaacaugaaucuggccccggcuguugcgccugcauuuccaggagagcggauccucuucuuucgaucuauggugcccuccgccggcgguuacgggagcggccagauugacugccugauaccucaggaauggguacaacacuucuaucaggaggcugcccccucgcagucugcagucgcccuuauccgcuacgugaacccagauacuggaagaaauauuuuugaagcuaagcugcacagggagggcuucaucaccguugccaacuccgggaauaacccuauaguggugcccccaaauggauauuuucgguucgaagcaugggucaaccaguuuuacacauugacuccgauggguaccggccaagggcgcagaaggaaucaguga

SEQ ID NO: 19560 - RNA, 1644 nt, Artificial Sequence
  derived and/or modified sequence opt3 from capsid_protein__Norovirus__BAL40872
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaagauacgccccguaugaggcugguggcaaugcuguacaccccucuccgggcuaauucgggcgaggacgucuuuacaguuucaugucgcguguuaacuagaccagcccccgauuucgaguuuaccuuccugguaccgccuacaguggaaagcaagaccaaacccuuuacucuuccaauuuugacacugggcgagcuaaguaacuccagguucccugcgcccaucgacaugcucuauaccgauccaaacgaaacgauugucgugcaaccccagaaugggcggugcacucuggacggaacccuucaggguacaacucagcugguuccuacccaaaucuguucuuuucgcggcacauugauaagccagaccucccgaucagccgauaguacggacagcgcaccaagagugaggaaccacccgcuccauguccagcugaagaauuuagaugggacucccuacgacccuacagacgaggugccagcuguacugggagccauugauuucaaaggcaccguuuucgguguggcuucucaacggaacacuacaggaaauuccgucggggccacccgugcacacgaagugcacaucgacacgaccaacccccgcuauacaccuaagcucggcucaguccuuaugaauagcgagaguucugauuuugacgauggccagccaacuugcuucacccccauugggaugggagccgacgauuggcaucagugggagcugccggaauacuccggucacuugacacuaaacaugaaucuggcuccugcgguggcaccagccuuucccggcgagagaauccucuucuuuaggagcguugugccuucggcugggggauacggcucuggucagaucgacugucugauuccccaagaauggguacagcauuucuaucaggaggccgcaccaucccagucagccgucgcucuuauacgguacgugaacccugauacugggcgaaauaucuuugaagccaagcugcaccgcgagggcuucauuaccguugcaaacaguggaaauaaccccaucguggucccaccgaauggcuauuuuagauucgaggcgugggugaaccaauuuuacacauugaccccuauggggacuggacaggguaggcggcgcguacaguga

SEQ ID NO: 19561 - RNA, 1644 nt, Artificial Sequence
  derived and/or modified sequence opt3 from capsid_protein__Norovirus__BAL40873
augaagauggccagcaacgacgcugcacccuccaaugauggcgccgcgaaccuggugccugaggcuaauaacgaagucauggcccucgagccaguugcaggggccucuaucgcugcaccggugguaggacagcaaaauauuauagaccccuggaucagagaaaacuucgugcaggccccucagggugaguuuaccgucucaccaaggaauagucccggcgaaaugcuucugaacuuggaguuagggccugagcugaauccauaccuaagccaccucucccggauguauaacggauacgcuggcgguaugcagguccaaguugugcuggccgggaaugcguucacagcaggaaaaauuaucuuugccgcugugcccccucauuucccaguggaaaacauuucugccgcacagaucacuaugugcccgcacguaauaguugaugugcgccagcuugagcccguccuguugccucucccagacauccgaaauagauuuuuccauuauaaccaggaagauacgccccguaugaggcugguggcuaugcuguacaccccucuccgggccaauucgggcgaggacguguuuacagucucaugucgcguuuuaacuagaccagcgcccgauuucgaguuuaccuuccuggugccgccuacaguagaaagcaagaccaaacccuuuacucuuccaauuuugacacugggcgagcuaaguaacuccagguucccugcccccaucgacaugcucuauaccgauccaaacgaaacgauugugguccaaccccagaaugggcggugcacucuggacggaacccuucaggguacaacucagcuggugccuacccaaaucuguucuuuucgcggcacauugauaagccagaccucccgaucagcagauaguacggacagcgcuccaagaguuaggaaccacccgcuccaugugcagcugaagaauuuagaugggacucccuacgacccuacagacgaggucccagccgugcugggagcuauugauuucaaaggcaccguauucgguguugccucucaacggaacacuacaggaaauuccgugggggcaacccgugcccacgaaguccacaucgacacgaccaacccccgcuauacaccuaagcucggcucagugcuuaugcauagcgagaguucugauuuugacgauggccagccaauuuccuucacucccaucgggaugggagcugacgauuggcaccagugggagcugccggaauacagcggucauuugacccuaaauaugaaccuggcgccugcagucgccccagcuuuucccggcgagagaauccucuucuuuaggucggugguuccuucugccgggggauacggcuccggucagauugacugccugauaccccaagaaugggugcagcacuucuaucaggaggcagccccaucacagagugcuguagcccuuguccgguacgugaauccugauacagggcgaaacaucuuugaagcaaagcugcaccgcgagggcuucuugacuguugcgaauagcggaaacaaucccauuguggucccaccgaacggcuauuuuagauucgaggcuugggugaaucaauuuuacacccucacaccuauggggaccggacaggguaggcggcgcguacaguga

SEQ ID NO: 19562 - RNA, 1626 nt, Artificial Sequence
  derived and/or modified sequence opt3 from capsid_protein__Norovirus__BAL60900
augagaaugagcgacggcgccgcucccaaggcaaacggguccgaggccucuggacaggaucuggugcucaccgcggucgaacaagcuguuccuauccagccaguggccggugcagcccuugcugcaccggccgcuggccagauuaaucagauagaccccuggaucuuccaaaacuuuguacagugcccucugggggaguucucaauuaguccaaggaauacacccggagaaaucuuguuugauuuagcccugggcccuggucuaaacccauaccucgcgcaccugagcgcaauguauacugggugggugggaaauauggagguccagcuugugcuggccggcaacgcuuucacggccggcaaaguuguggucgcauuggugcccccuuacuuuccaaaggggucccucaccacagcucagauuacuuguuucccgcauguaaugugcgacguucggacccuggaacccauccaacugccucucuuagaugugcgccgaguccuguggcacgccacacaggaccaggaggagucuaugcgucuuguguguauguuguauaccccacugagaacuaauucgcccggagaugaaucauuuguggucagcgguaggcuacucaguaaaccugcggccgacuucaacuuuguuuaccugacaccacccauagagcggaccaucuaucgcaugguggaucuuccgguacugcagccuagauugugcacgcaugcaagguggcccgcuccaguguacggccuccuggucgacccuuccuuacccucuaauccacaauggcagaacgggcgggugcacguugauggaacucugcucggcaccacacccgugagcgguuccugggucucauguuucgccgcugaagccgcauaugaguuucagagugggacuggagagguggccaccuucacacuuauugaacaagacggcagcgcuuacguaccuggcgagcgcgcggcaccacugggguacccggauuuuucuggacaguuggaaaucgagguucagaccgaaacgacuaagcgaggugagaaacuaaaggugacaaccuucgagaugauucugggccccacuacaaaugucgaccaggccccuuaucaagggagaguguacgcuucccucucagccgcagccagccuggaccuugucgauggaagggugcgggcuguuccacguaguaucuauggcuuccaggacgugauacccgaauacaacgauggucuguugguaccucucgccccacccauugggccguuucugccuggcgaggucuuacugcgcuucagaaccuauaugaggcaaguggacucuuccgaugcagcggcugaagccaucgacugcgcacuaccacaggaguuuguuagcugguucgccucgaauggauuuacggugcagucugaagcucuccugcuucgguaccgaaacaccuugacaggccagcuccuguucgaguguaagcuguauuccgagggguacauugcccuuucauacaguggaagcgguccccugacuuuuccuaccgauggcuucuuugaagucguguccuggguaccccgcuuguaucagcucgcaucuguggggagccugguuacaggaagaacuuuaaaacaguga

SEQ ID NO: 19563 - RNA, 1623 nt, Artificial Sequence
  derived and/or modified sequence opt3 from capsid_protein__Norovirus__BAQ55211
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgagcacuuaccggaugaaccucgccucucagaauuggaacaauuaugaucccacagaggaaauuccugcaccacuggguacccccgacuucguagggaagauccagggaaugcuuacucagacaaccaagggcgacggcuccacgcgcgggcacaaggcuaccguuucaacaggaagcguggauuuuacuccuaaacuggguaguguccaauucgccaccgacacagauaacgacuuugagacuggccagaauacccgauucacaccagugggggucauccaggauggaucuggcgcucauagaaacgaaccccaacaguggguguugccgaauuacuccgguaggaccguucacaacgugcaccucgccccugcaguagccccaacuuuucccggggagcagcuguuauucuuucggagcacgaugccuggcuguucgggauaccccaauauggaccuggauugccuccuuccacaggaauggguccaacauuucuaucaggaggcugcgccugcacagucugacguggcccuguugcguuuuguuaaccccgauacaggccgcgugcuauucgaguguaagcugcacaaaaccggguacgucacuguggcucauaccggacagcacgaccucguaauuccaccgaaugguuauuuuagauucgauuccugggugaaccaauucuacacacuggccccuaugggcaacggggcaggaaggcggcgagcccuuuga

SEQ ID NO: 19564 - RNA, 1623 nt, Artificial Sequence; identical to SEQ ID NO: 17968
  derived and/or modified sequence opt3 from capsid_protein__Norovirus__BAQ55212

SEQ ID NO: 19565 - RNA, 1620 nt, Artificial Sequence
  derived and/or modified sequence opt3 from capsid_protein__Norovirus__BAQ55213
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcacgucuacuuaccggaugaaccucgccucccagaauuggaacaauuaugauccgacagaggaaauucccgcaccucuggguaccccagacuucguagggaagauccagggaaugcuuacucagacaaccaagggcgacggcucaacgcgcgggcacaaggcuaccguuagcacaggaaguguggauuuuacucccaaacuggguucuguccaauucgacaccgauacaaacaaugacuuggagacuggccagaacacccgauuuacaccugugggggucauccaggauggauccgcccauagaaaugaaccacaacagugggugcuccccgacuacagcggcaggaccguucacaacgugcaccuggcuccggccguagcaccuacuuucccaggugagcaguuacuguuuuuccggucgacgaugcccggguguucuggcuacccuaauauggaucucgacugccuucugccccaggaauggguccaacauuuuuaucaggaggccgcuccagcgcaguccgauguggcauugcuacguuucguuaacccugacacaggacgcgugcuguuugaguguaagcuccacaaaaccggcuacgucacuguggcccauaccgggcagcacgaucugguaauucccccaaauggauauuucagauuugacucaugggugaaccaauucuacacacuugcuccgauggguaacggcgccgggaggcggcgagcacuguga

SEQ ID NO: 19566 - RNA, 1623 nt, Artificial Sequence
  derived and/or modified sequence opt3 from capsid_protein__Norovirus__BAQ55214
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcacgucuacuuaccggaugaaccucgccucccagaauuggaacaauuaugauccgacagaggaaauucccgcaccucuggguaccccagacuucguagggaagauccagggaaugcuuacucagacaaccaagggcgacggcucaacgcgcgggcacaaggcuaccguuagcacaggaaguguggauuuuacucccaaacuggguucuguccaauucgccaccgacacagauaacgacuuugagacuggccagaauacccgauucacaccugugggggucauccaggauggauccggcgcucauagaaacgaaccacaacaguggguguugcccgacuacagcgguaagaccguucacaaugugcaccucgccccggcaguagccccuacuuuuccaggggagcagcuguuauucuuuaggucgacgaugcccggcuguucuggauacccuaacauggaucuggacugccuccuuccccaggaauggguccaacauuucuaucaggaggcugcgccagcacaguccgauguggcccuguugcgguuuguuaauccugacacaggccgugugcuauucgaguguaaacugcacaagaccggguacgucacuguggcucauaccggacagcacgaucucguaauucccccaaacgguuauuuucgcuucgacucaugggugaaucaauucuacacacuggccccgaugggcaacggggcaggaagaaggcgggcccuuuga

SEQ ID NO: 19567 - RNA, 1620 nt, Artificial Sequence
  derived and/or modified sequence opt3 from capsid_protein__Norovirus__BAQ55215
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgacaccgauacaaacaaugacuuggagacuggccagaacaccagauuuacaccagugggggucauccaggauggaagugcccauaggaaugaaccccaacagugggugcucccggacuacucuggccggaccguucacaacgugcaccuggcuccugccguagcaccaacuuuccccggugagcaguuacuguuuuuccguuccacgaugccuggguguagcggcuaccccaauauggaucucgacugccuucugccacaggaauggguccaacauuuuuaucaggaggccgcuccugcgcagucggauguggcauugcuacgcuucguuaaccccgacacaggaagagugcuguuugaguguaagcuccacaaaaccggcuacgucacuguggcccauaccgggcagcacgaucugguaauuccaccgaauggauauuucagguuugacucuugggugaaccaauucuacacacuugcuccuauggguaacggcgccgggcggcgacgcgcacuguga

SEQ ID NO: 19568 - RNA, 1620 nt, Artificial Sequence
  derived and/or modified sequence opt3 from capsid_protein__Norovirus__BAQ55216
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagaucaccauguucccucauauaaucguagacguucgccaacuggagccagugcuuauuccccugccugauguccgaaacaauuuuuaucacuacaaccagucaaaugacagcacaaucaaguugauugcaaugcucuauacuccacugcgugcuaacaacgccggggaugacguguucaccgugaguugcagaguccugacaaggcccuccccggauuuugacuucaucuuucucguuccucccaccguggaaucucggacuaaaccauucacaguaccuauauuaaccguggaggaaaugacgaauagccgcuuucccauuccacuggagaaacuuuucacuggacccuccucagcguucgucgugcagccucagaacgguagauguaccacagauggcguuuugcuggggacuacccaacuaaguccagugaauaucugcacauuuaggggagacgucacccauauuccgggcacgcggacuuaccgcaugaaccucgccagccagaauuggaacaauuaugaucccacagaggaaaucccugcaccacuggguacccccgacuucguggggaagauccagggaaugcuuacucagacaaccaagggcgacggcucuacgcgagggcacaaggcuaccguauccacaggaucaguugauuuuacuccuaaacuggguagcgugcaauucgacaccgauacaaacaaugacuuggagacuggccagaacaccagauuuacaccagucggggugauucaggauggaagugcccauaggaaugaaccccaacaguggguccucccggacuacucuggccggaccgugcacaacguucaccuggcuccugccguggcaccaacuuuccccggugagcaguuacuguuuuuccguuccacgaugccuggguguagcggcuaccccaauauggaucucgacugccuucugccacaggaauggguacaacauuuuuaucaggaggccgcuccugcgcagucggaugucgcauugcuacgcuucgugaaccccgacacaggaagaguucuguuugaguguaagcuccacaaaaccggcuacgugacugucgcccauaccgggcagcacgaucuggugauaccaccgaauggauauuucagguuugacucuuggguaaaccaauucuacacacuugcuccuauggguaacggcgccgggcggcgacgcgcacuguga

SEQ ID NO: 19569 - RNA, 1620 nt, Artificial Sequence
  derived and/or modified sequence opt3 from capsid_protein__Norovirus__BAQ55217
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcacgcacacuuaccggaugaaccucgccucucagaauuggaacaauuaugauccgacagaggaaauucccgcaccucuggguaccccagacuucguagggaagauccagggaaugcuuacucagacaaccaagggcgacggcuccacgcgcgggcauaaggcuaccguuucaacaggaagcguggauuuuacucccaaacuggguaguguccaauucgccaccgacacaaacaaugauuuugagacuggccagaacacccgauucacaccugugggggucauccaggacggaucugcucacagaaaugaaccacaacaguggguguugcccgauuacuccggcaagaccguucacaacgugcaucucgccccggcaguagccccuacuuuuccaggugagcagcuguuauucuuuaggagcacgaugcccggguguucgggcuacccuaauauggaccuggauugccuccuuccccaggaauggguccaacacuucuaucaggaggcugcgccagcacagucugacguggcccuguugcgguuuguuaacccugauacaggacgugugcuauucgaguguaaacugcauaagaccggcuacgucacuguggcucacaccgggcagcacgaccucguaauucccccaaauggauauuuucgcuucgauuccugggugaaccaauucuacacacuggccccgauggguaacggcgcagggagaaggcgggcccuuuga

SEQ ID NO: 19570 - RNA, 1623 nt, Artificial Sequence
  derived and/or modified sequence opt3 from capsid_protein__Norovirus__BAQ55218
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgaacacgcacacuuaccggaugaaucucgccagccagaacuggaauaacuaugaucccacagaggaaauuccugcaccacugggcacccccgacuucguagguaagauccaggggaugcuuacucagacaaccaagggagacggcucuacgcgcggccauaaggcuaccguuuccacagggucaguggauuuuacuccuaaacugggaagcguccaauucaccacagacacugauaaugacuuugagaccggucagaacacacgauucaccccagugggcgucauccaggaugggaauggagcccacagaaacgaaccccaacaguggguguugccggacuacaguggcgguacuguucacaaugugcaucucgcuccugccguagcaccaacguuucccggggagcagcuguuauucuuuaggucuacaaugccuggcuguuccggauaccccaacauggaucuggacugccuccuuccacaggaauggguccaacacuucuaucaggaggccgcuccugcgcagagcgauguggcacuguugcgguuuguuaaucccgacaccggccgugugcuauucgaguguaagcugcauaaaacuggguacgucaccguggcccacacaggacagcacgaucucguaauuccaccgaacgguuauuuucgcuucgacucgugggugaaccaauucuacacccuggcuccuaugggcaauggggccggaagaaggcgggcacuuuga

SEQ ID NO: 19571 - RNA, 1623 nt, Artificial Sequence; identical to SEQ ID NO: 18181
  derived and/or modified sequence opt3 from capsid_protein__Norovirus__BAR47396

SEQ ID NO: 19572 - RNA, 1623 nt, Artificial Sequence; identical to SEQ ID NO: 18672
  derived and/or modified sequence opt3 from capsid_protein__Norovirus__BAR47397

SEQ ID NO: 19573 - RNA, 1623 nt, Artificial Sequence
  derived and/or modified sequence opt3 from capsid_protein__Norovirus__BAR47398
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgacuuuacccccaaauuggguuccguccaguucucaacagauacugaaaaugacuuugagacccaucaaaacacaaaguucacuccugugggcgucauccaggaugggagcaccacacaccgaaaugaaccacagcaaugggugcuccccaguuacucuggaagaaacguucacaaugugcaucuggcuccggcgguagcaccuaccuuuccaggcgagcaguuacuguucuuuagguccacuaugcccgguuguagcggguauccuaacauggaccucgauugccuucugccccaggaguggguccagcacuucuaccaagaagccgcuccagcccagucggacguggcauugcuacgguuuguuaauccugaucagggccgugugcuguucgaguguaaacuccauaagucuggauaugucacgguggcccacacaggccagcacgaccugguaauucccccaaacggguacuuucgcuucgauuccugggugaaccaauucuauacccuugcuccgaugggaaaugguacuggcagaaggcgggcccuguga

SEQ ID NO: 19574 - RNA, 1623 nt, Artificial Sequence; identical to SEQ ID NO: 18712
  derived and/or modified sequence opt3 from capsid_protein__Norovirus__BAR47400

SEQ ID NO: 19575 - RNA, 1623 nt, Artificial Sequence
  derived and/or modified sequence opt3 from capsid_protein__Norovirus__BAR47401
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuacauuaaccgucgaagagaugacgaacucucgcuuucccaucccacuggagaaacuuuucacuggacccagcuccgccuucgugguucagccucagaaugguagauguaccacagacggcguguugcuggggacuacccaacuaucaccagucaacauaugcacauuuaggggagaugugacccauauugcaggcagucgggacuacacgaugaaucucgcuagccugaacuggaauaacuaugauccgacugaagagauccccgccccucuugguacaccagacuucguagggaagauucagggaguucugacccagacuacaaagggcgacggcucuacccgcgggcacaaggcuacgguguacaccggauccgcccccuuuacaccuaaauuggguucaguccgauucagcacugauaccgaaaaugacuuugagacacaucagaacacuaaguucaccccagugggcgucauccaagaugggaguacaacccacagaaaugaaccccagcagugggugcucccgucuuacuccggaagggacguucacaacgugcaucuggccccugcaguagcuccaacuuuucccggcgagcaauuacuguucuuucggagcacgaugccugguuguucgggguaucccaauauggaucucgacugccuucugccacaggaguggguccagcacuucuaccaggaagcggccccugcacaaucugauguggcuuugcuacguuuuguuaaccccgacacaggccgcgugcuguucgaguguaaacuccauaaguccggauaugucaccguggcccacacuggccagcacgaucugguaaucccaccgaauggguacuuuagauucgacucaugggugaaccaguucuauacccuugcaccuaugggaaacgguacaggcaggcggcgagcccuguga

SEQ ID NO: 19576 - RNA, 1623 nt, Artificial Sequence
  derived and/or modified sequence opt3 from capsid_protein__Norovirus__BAR47403
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccaucuacacgggauccgcccccuuuaccccuaaauuggguucagugcaguucagcacagacacugaaaacgauuuugagacccaucaaaauacaaaguucacuccagucggcgugauucaggacgggggaaccacacaccgaaacgaaccccagcaauggguccucccgaguuacucuggcagagaugugccuaauguucaccuggcaccagccguggcucccaccuuuccuggugagcaguuacuguucuuuagguccacuaugcccggguguagcggcuauccaaacauggaccucgauugccuucugccucaggaguggguacagcauuucuaccaagaagcggcacccgcccagucggacgucgcuuugcuacgguuugugaauccagauacgggacguguucuguucgaguguaaacuccacaagucuggcuaugugacagucgcccauaccgggcagcacgaccuggugauaccgccuaacggauacuuucgcuucgauuccuggguaaaccaguucuauacucuugcacccauggguaauggcaccgggagaaggcgggcccuguga

SEQ ID NO: 19577 - RNA, 1623 nt, Artificial Sequence; identical to SEQ ID NO: 18261
  derived and/or modified sequence opt3 from capsid_protein__Norovirus__BAR47404

SEQ ID NO: 19578 - RNA, 1623 nt, Artificial Sequence
  derived and/or modified sequence opt3 from capsid_protein__Norovirus__BAR47405
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaaugcugacacagaccacuaagggcgacggcuccacacgcgggcacaaggcuaccguuuacacgggaucaacccccuuuacaccuaaauuggguagcgugcaguucaguacugacaccgaaaaugauuuugagacacaucaaaacacuaaguucaccccagucggcgugauccaggacgggucuacaacccaccgaaaugaaccccagcaauggguccucccguccuacagcggaagaaacgugccuaauguucaccuggccccagcaguggcccccacuuuuccuggcgagcaguuacuguucuuuaggucgacgaugcccgguuguucuggguauccaaacauggaucucgacugccuucugccucaggaguggguacagcauuucuaccaagaagcugcgcccgcacaguccgaugucgccuugcuacgguuugugaauccagacacaggccguguucuguucgaguguaaacuccacaagucaggauaugugaccgucgcucauacuggccagcacgaucuggugauuccgccuaacggguacuuucgcuucgacaguuggguaaaccaguucuauacccuugcccccaugggaaaugguacaggcagaaggcgggcacuguga

SEQ ID NO: 19579 - RNA, 1623 nt, Artificial Sequence; identical to SEQ ID NO: 18871
  derived and/or modified sequence opt3 from capsid_protein__Norovirus__BAR47406

SEQ ID NO: 19580 - RNA, 1623 nt, Artificial Sequence
  derived and/or modified sequence opt3 from capsid_protein__Norovirus__BAR47407
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagcgguaacuacaccaugaaucucgcuucuguaaacuggaauaacuaugacccgacggaagagauucccgccccucuggggacuccagauuucguuggaaagauccagggcaugcuuacacagaccacuaagggcgacggguccacacggggacacaaggcuaccguguacacggguucagcccccuuuaccccuaaacugggcagcguccaguucaguacagacacugaaaaugauuuugagacccaucaaaacacaaaguucacuccagugggggucauccaggacggaaauaccacacaccgcaacgaaccccagcaauggguguugccgucuuacuccggccgaaauguuccuaacgugcaccucgcaccagccguagcucccaccuuuccuggugagcagcuguuauucuuuagaagcacuaugcccggguguucgggcuauccaaauauggaucuggacugccuccuuccucaggaguggguccagcauuucuaccaagaagcggcacccgcccagucugauguggcucuguugagguuuguuaacccagacacgggacgggugcuauucgaguguaaacugcacaaguccggcuaugucacaguggcccauaccgggcagcacgaucucguaauuccgccuaacggauacuuucguuucgacucaugggugaaucaguucuauacucuggcacccauggguaacggcaccgggcgcagaagggcccuuuga

SEQ ID NO: 19581 - RNA, 1623 nt, Artificial Sequence
  derived and/or modified sequence opt3 from capsid_protein__Norovirus__BAR47408
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggaucaaaaacaauuucgugcaggcaccugguggcgaauuuaccguuucaccaagaaacgcccccggggagauacuuuggagugcuccucugggaccagauuugaaucccuacuuaagccaccuggccaggauguauaacggcuacgcggguggguucgaagugcaggucauucuagcaggaaaugccuuuacagcuggcaagaucauuuucgccgcagugccuccaaacuuuccgacugagggccucucccccucucagguaacgauguucccucauaucauaguugacgugcggcaacuggagccaguccuuaucccccugccugaugugcgcaauaacuuuuaucacuacaaucagucgaacgacucaaccauuaaauugaucgcuaugcucuauacaccacugcgagccaacaaugcgggggaagauguguucacugucagcugccguguucugaccagacccaguccggacuuugauuucauuuuucucgugccucccacaguagaguccaggaccaagccauucacugugccuaucuuaacagucgaagagaugaccaacucucgguuucccauaccacuggagaaacuuuucacgggacccagcggugccuucgugguucagccucagaauggccgcuguacuaccgacgggguguugcugggaacaacucaacuauccccagucaacauuugcaccuuuagaggcgaugugacacauaucgcagguucaaggaauuacaccaugaaccucgcugcccugaauuggaacaauuaugacccgacggaagagauucccgcuccucuugggacuccagauuucguaggaaagauccagggcguucugacacagaccacuaagggcgacgggaguacacggggacacaaagccaccguguacacggguagcgcagacuuuacccccaaguugggcucuguccaguucuccacagauacugaaaacgacuuugagacccaucaaaauacaaaauucacuccugugggggucauccaggauggaucaaccacacaccgcaacgaaccacagcaaugggugcuccccagcuacaguggccgaaauguucacaacgugcaucuggccccggcuguagcgccuaccuuuccaggugagcaguuacuguucuuuagaucuacuaugcccggguguuccggcuauccuaauauggaccucgauugccuucugccccaggaguggguccagcacuucuaccaagaagcagccccagcucagagcgacguggccuugcuaagguuuguuaacccugauacgggacgggugcuguucgaguguaagcuccauaaaucgggcuaugucacaguggcacacaccgggcagcacgaccugguaauucccccaaacggauacuuucguuucgauucuugggugaaucaguucuauacucuugccccgauggguaacggcaccgggcgcagaagggcucuguga

SEQ ID NO: 19582 - RNA, 1623 nt, Artificial Sequence; identical to SEQ ID NO: 18997
  derived and/or modified sequence opt3 from capsid_protein__Norovirus__BAR47410

SEQ ID NO: 19583 - RNA, 1623 nt, Artificial Sequence
  derived and/or modified sequence opt3 from capsid_protein__Norovirus__BAR47412
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagaauccaauucgagacagacacugaucaugacuuugaagcaaaucagaacaccaaauucacaccaguggguguuauucaggauggcgggacuacccacaggaaugagccccaacaguggguguugccgagcuacaguggacggaacacacacaauguacaucucgccccugcugucgcgccaaccuuucccggcgaacagcuguuauucuuucguucuacuaugccugguuguuccggguaucccaacauggaccuggauugccuccuuccacaggagugggugcaauacuucuaucaggaggcagccccugcucagagcgacguugcccuguugcgcuuugugaaucccgauacgggcagaguccuauucgaauguaagcugcacaaaucgggauacgugacaguagcacauaccggccagcacgaccucgugaucccaccgaacggguauuuuagguucgauucuuggguuaaccaauucuacacucuggccccuaugggaaaugguaccggccggcgacgcgucgcuuga

SEQ ID NO: 19584 - RNA, 1623 nt, Artificial Sequence
  derived and/or modified sequence opt3 from capsid_protein__Norovirus__BAR47413
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagaauccaauucgagacagacacugaucaugacuuugaagcaaaucagaacaccaaauucacaccaguggguguuauucaggauggcgggacuacccacaggaaugagccccaacaguggauguugccgagcuacaguggacggaacacacacaaugugcaucucgccccugcuguagcgccaaccuuucccggcgaacagcuguuauucuuucguucuacuaugccugguuguuccggguaucccaacauggaccuggauugccuccuuccacaggaguggguccaauacuucuaucaggaggcagccccugcucagagcgacguggcccuguugcgcuuuguuaaucccgauacgggcagagugcuauucgaauguaagcugcacaaaucgggauacgucacaguggcacauaccggccagcacgaccucguaaucccaccgaacggguauuuuagguucgauucuugggugaaccaauucuacacucuggccccuaugggaaaugguaccggccggcgacgcguugcuuga

SEQ ID NO: 19585 - RNA, 1623 nt, Artificial Sequence; identical to SEQ ID NO: 19584
  derived and/or modified sequence opt3 from capsid_protein__Norovirus__BAR47414

SEQ ID NO: 19586 - RNA, 1623 nt, Artificial Sequence; identical to SEQ ID NO: 19584
  derived and/or modified sequence opt3 from capsid_protein__Norovirus__BAR47415

SEQ ID NO: 19587 - RNA, 1623 nt, Artificial Sequence; identical to SEQ ID NO: 18511
  derived and/or modified sequence opt3 from capsid_protein__Norovirus__BAR47417

SEQ ID NO: 19588 - RNA, 1623 nt, Artificial Sequence
  derived and/or modified sequence opt3 from capsid_protein__Norovirus__BAR47418
augaagauggccagcuccgacgcuaaucccccugauggcucugcagccaaccuggugccagaggucaacaaugaaguuauggcgcucgagccggugguaggggcugccaucgcagcccccguggcuggacagcaaaacgucauugacccuuggauaagaaauaacuucgugcaggcaccagguggcgaauuuaccguuucacccaggaaugccccuggggagauccuuuggagugcuccacugggacccgauuugaacccuuacuuaagccaccuggcccggauguauaauggcuacgcggguggguucgaagugcaggucauucuagcaggaaacgccuuuacagcuggcaaagugaucuucgccgcaguaccaccgaauuuucccacugagggccucuccccuucucagguuacgauguucccacauauuguggucgacgugcgccaacuggagcccgugcuuaucccucugccagauguccgaaacaauuuuuaucacuacaaccagucgaaugaccccaccauaaaguugaucgcuaugcucuauacaccgcugcgugccaacaacgcgggggaugacguuuucacugugucaugcagaguacugaccaggccuagccccgauuuugacuucauuuuucucgugccaccuacagucgaaagucggaccaaacccuucuccgugccaguuuuaacuguggaggaaaugacaaauucucgcuuucccaucccucuggagaaacuuuucaccggaccaagcuccgccuucgucgugcagccgcagaacgguagauguacgacugauggcguauugcuggggaccacacaacuaucacccguuaauauuugcacuuuuaggggagacgugacccauaucacaggcagucacaacuacaccaugaaucucgcaagccagaacuggaauaacuaugauccuacggaggaaauaccagcuccccuggguacuccugacuucgucgggaagauucagggagugcuuacacagaccacucggacagacggcucuacccgcggccauaaggccacggucuacaccggguccgcugauuuugccccaaagcugggacgagugcaauucgagacagacacuaaucacgauuuugaagcaaaccagaauaccaaauucacacccguuggugugauccaggacggcgggacuacccacagaaacgagccgcaacaguggguauugccuucauacagcggaaggaauacacauaacguccaccucgccccagcuguggcgcccaccuuuccuggcgaacagcuguuauucuuucggaguacuaugcccgguuguucuggguauccaaauauggaucuggacugccuccuuccucaggaguggguucaauacuucuaucaggaggcagcccccgcucaguccgauguggcccuguugcguuuugucaacccagacacgggccgcgugcuauucgaauguaagcugcauaaaagcggauacguaacaguggcacacaccggccagcacgaucucguuauuccgccuaacggguauuuuagauucgacucgugggucaaucaauucuacacucuggcccccaugggaaacgguaccggcaggcggcgagcuguguga

SEQ ID NO: 19589 - RNA, 1623 nt, Artificial Sequence
  derived and/or modified sequence opt3 from capsid_protein__Norovirus__BAR47421
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacacacaacguccaucucgccccugcuguggcgccaaccuuucccggcgaacagcuguuauucuuucguuccacuaugccugguuguagcggguaucccaauauggaccuggauugccuccuuccacaggaguggguucaauacuucuaucaggaggcagccccugcucagucggacguggcccuguugcgcuuugucaaccccgauacgggcagagugcuauucgaauguaagcugcacaaaucuggauacguaacaguggcacauaccggccagcacgaccucguuauuccaccgaauggguauuuuagguucgauuccugggucaaccaauucuacacucuggccccuaugggaaacgguaccggccggcgacgcgcuguguga

SEQ ID NO: 19590 - RNA, 1623 nt, Artificial Sequence; identical to SEQ ID NO: 18317
  derived and/or modified sequence opt3 from capsid_protein__Norovirus__BAR47422

SEQ ID NO: 19591 - RNA, 1623 nt, Artificial Sequence
  derived and/or modified sequence opt3 from capsid_protein__Norovirus__BAR47423
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugauagggacuuugaagcaaaucagaacaccaaauucacaccaguuggugugauccaggauggcgggacuacccaucggaaugagccccaacaguggguauugccgagcuacaguggacguaacacaccuaauguccaccucgccccagcuguggcgcccaccuuuccuggcgaacagcuguuauucuuucgcucuacuaugcccgguuguuccggguauccaaacauggaccuggauugccuccuuccucaggaguggguucaauacuucuaucaggaggcagcccccgcucagagcgacguggcccuguugagauuugucaauccagauacgggcagggugcuauucgaauguaagcugcacaaaucgggauacgcaacaguagcccauaccggccagcacgaccucgugauuccgccuaacggguauuuucgguucgauucuuggguuaaccaauucuacacucuggcucccaugggaaaugguaccggccgacgcagagcccuuuga

SEQ ID NO: 19592 - RNA, 1623 nt, Artificial Sequence; identical to SEQ ID NO: 18319
  derived and/or modified sequence opt3 from capsid_protein__Norovirus__BAR47424

SEQ ID NO: 19593 - RNA, 1623 nt, Artificial Sequence; identical to SEQ ID NO: 18597
  derived and/or modified sequence opt3 from capsid_protein__Norovirus__BAR47426

SEQ ID NO: 19594 - RNA, 1623 nt, Artificial Sequence; identical to SEQ ID NO: 18261
  derived and/or modified sequence opt3 from capsid_protein__Norovirus__BAS53731

SEQ ID NO: 19595 - RNA, 1623 nt, Artificial Sequence
  derived and/or modified sequence opt3 from capsid_protein__Norovirus__BAS53732
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccgggccaaaccauucaccgugccuaucuuaacugucgaggaaaugacaaacucucgcuuucccauaccacuggagaaacuuuucaccggacccagcuccgcauucgugguucagccucagaaugguagauguacgacugauggcguguugcuggggaccacacaacuaucaccagucaacauuugcacuuuuaggggagacgugacccauaucgcuggcagucggaauuacacaaugaaccucgccagccugaauuggaacaauuaugauccgaccgaggaaauucccgcuccucuugguacgccagacuucguagggaagauccagggaguucugacucagacaaccaagggcgacggcucuacucgcgggcacaaggccacaguguacaccggauccgcagauuuuacgcccaaauuggguucaguccaguucggcaccgacacagagaacgauuuugaaacucaucaaaauaccaaguucacaccugugggggucauccaggacggaggcacuacccaccgaaacgagccacagcaaugggugcuccccagcuacagugguagaaauguucacaacgugcaucuggccccggcuguagcgccuaauuuuccaggggaacaguuacuguucuuuaggucuacaaugcccggcuguuccggauauccuaacauggaucucgacugccuucugccccaggaguggguccagcacuucuaccaagaggcagccccagcucagagcgauguggccuugcuacgguuuguuaacccugacaccggccgugugcuguucgaauguaaacuccauaagucgggguaugucacuguggcacacacgggacagcacgaucugguaauucccccaaaugguuacuuucgcuucgacucuugggugaaccaguucuauacacuugccccgaugggcaaugggaccggaagaaggcgggcucuguga

SEQ ID NO: 19596 - RNA, 1623 nt, Artificial Sequence
  derived and/or modified sequence opt3 from capsid_protein__Norovirus__BAS53733
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucagucgaacgacucaacgaucaaguugauugcuaugcucuauaccccacugcgugccaacaaugcgggggaugacguguucacagucagcugcagaguucugacuaggcccaguccggauuuugacuucaucuuucucgugccucccaccguagaaucccggacaaaaccauucaccgugccuauauuaacugucgaggaaaugacaaacucucgcuuucccauuccacuggagaaacuuuucaccggacccagcuccgccuucgugguucagccucagaaugguagauguacgacugauggcguguugcuggggaccacacaacuaucaccagucaacaucugcacuuuuaggggagacgugacccauauugcaggcagucggaauuacacaaugaaccucgcuagccugucuuggaauaacuaugauccgaccgaggaaauccccgccccucuugguacgccagacuucguagggaagauccagggaguucugacucagacaaccaagggcgacggcuccacucgcgggcacaaggcuacaguguacaccggaucagcccccuuuacgccuaaauuggguagcguccaguucaguaccgauacagagaaugacuuugaaacucaucaaaacaccaaguucacaccagugggcgucauucaggaugggggaacuacccaccgaaaugagccccagcaaugggugcucccgucuuacuccggcagaaacguuccuaaugugcaccuggcaccagccguagcucccacauuuccuggugaacaguuacuguucuuuaggagcaccaugcccggguguucgggcuauccaaacauggaccucgauugccuucugccucaggaguggguccagcauuucuaccaagaggcggcacccgcccagucugacguggcuuugcuacgguuuguuaauccagauacuggacgugugcuguucgaauguaaacuccacaaguccggcuaugucacgguggcccauacagggcagcacgaccugguaauaccgccuaacggauacuuucgcuucgauucaugggugaaccaguucuauacccuugcacccauggguaauggcacugggagaaggcgggcccuguga

SEQ ID NO: 19597 - RNA, 1623 nt, Artificial Sequence
  derived and/or modified sequence opt3 from capsid_protein__Norovirus__BAS53734
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucggcacagacacugagaacgauuuugaaacccaucaaaauacaaaguucacuccugugggggucauccaggacggaagcaccacacaccgaaacgagccacagcaaugggugcuccccaguuacucuggcagaaauguucacaacgugcaucuggcaccggccguagcuccuaauuuuccaggugaacaguucuuauuuuucagguccaccaugcccggguguagcggcuauccuaacauggaucuggacugccuccuuccccaggaguggguccagcacuuuuaccaagaggcggcaccagcccagucggauguggcucuguugcgguucguuaacccugacacuggacgugugcuauuugaauguaaacugcauaagucuggcuaugucacgguggcccacacagggcagcacgaucucguaauucccccaaauggauacuuccgcuucgacuccugggugaaccaguuuuauacccuggcaccgauggguaauggcacugggagaaggcgggcccuuuga

SEQ ID NO: 19598 - RNA, 1623 nt, Artificial Sequence
  derived and/or modified sequence opt3 from capsid_protein__Norovirus__BAS53945
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccacacccuccccggacuuugauuucauuuuucucgugccucccaccguagagucuaggacuaaaccauucacagugccuaucuuaaccgucgaagagaugacgaauagccgguuucccauaccacuggagaaacuuuucacuggacccuccucagccuucgugguucagccucagaacggucgcuguaccacagacggcguguugcuggggacuacccaacuaaguccagucaauauuugcacauuuagaggagaugugacccauaucgcaggcagcaggaacuacacgaugaaucucgcuucucugaacuggaauaacuaugacccgacugaagagauucccgccccucuugguacaccagauuucguagggaagauccagggaaugcugacccagacuacaaagggcgacggcuccacccgggggcacaaggcuacgguuuacaccggaucagcccccuuuacaccuaaauuggguagcgugcaguucaguacugacaccgaaaaugauuuugagacacaucaaaacacuaaguucaccccagucggcgugauccaggacgggaauacaacccaccgcaacgaaccccagcaauggguccucccgucuuacuccggacgaaaugugccuaacguucaccuggcaccagccguggcucccacuuuuccuggcgagcaguuacuguucuuuagaagcacgaugcccgguuguucgggguauccaaauauggaucucgacugccuucugccucaggaguggguacagcauuucuaccaagaagcggcacccgcccagucugaugucgcuuugcuaagguuugugaacccagacacaggccggguucuguucgaguguaaacuccacaaguccggauaugugaccgucgcccauacuggccagcacgaucuggugauuccgccuaacggguacuuucguuucgacucauggguaaaucaguucuauacccuugcacccaugggaaacgguacaggccgcagaagggcccuguga

SEQ ID NO: 19599 - RNA, 1632 nt, Artificial Sequence
  derived and/or modified sequence opt3 from capsid_protein__Norovirus__CAK22261
augaugauggccagcaaggacgcuucccccucugcagauggcgccaacggggcgggacagcuggugccugaggucaauaacgcugaaccacucccgcuugaccccguugccggugcaucaaccgcccuggcuacagcaggccaagugaauaugaucgauccuuggauuuucaacaauuuuguacaggccccacagggggaguucacuauaagucccaacaauacgccuggagacaucuuguuugauuuacagcugggcccacaccuaaaccccuuccucgcucaucugagccaaauguacaaugguuggguggggaacaugagagucagggugauucuugccggaaaugcguuuaccgcaggcaaaguuaucgugugcugugucccuccaggcuuccagucccggacacugucuauugcccaggcuacuuuguuuccgcacaucauagccgacgugcgcacccucgaacccaucgagauuccucuggaagauguacgaaacacacuguaucauaccaaugacaaccagccaacuaugcgucucuuaugcaugcuguacacaccccuuagaaccgggggagguucgggcgggacggaugcauucguuguggcuggaagggucuugacuuguccuucaagcgacuuuaauuuccuguuucuagugccacccaccguggagcaaaagacacggccguucagugucccuaacaucccccuccagcugcuuuccaacucucgcguuccaaaucugauucagagcaugguguuguccccugaucaggcccaaaacguacaguuucagaauggcagaugcacuaccgacggucaacuccuggggacaacccccgugucagucagucagaucuuaaaauucaggggaaaggugagcgcgggcucucggguuauaaaccugacggagcucgauggcuccccauuccuugccuuugaagcacccgcuccuacuggguucccagaccugggaacaucagacuggcacguggagaugagcuugaauaguaacucucaguccagcgguaauccgauucuacugcgcgauauccagcccaacucgucugacuuugucccucaucucggcuccguggccguaaccacugcuauugauguugccggggacuauacaggaaccauccaauggacgucacagccaaguaaugugacccccgucccugaugugaacuucuggacaaucccacaguacggcagcaaucuggcagaagccucccagcuugcucccgucguguauccgccugguuuuggggaggcgauuguuuacuucaugucuccaauacccggcccuaacacugcacacaaacccaaucuggugccauguuugcucccucaagaguuuguaacccacuucgucagcgaacaggcccccucaaugggagaggcugcccuggugcauuauguugacccagauacaaaccgaaauuuaggcgaauuuaagcuguacccggagggguucaucacuugcgugccuaacggaaccgguccccagcagcuaccacucaacggcgucuuuguguucgcaaguuggguauccagauuuuaccaacugaagcccguggggacagccagcucugcuaggggacggcuuggcguucgucgcuga

SEQ ID NO: 19600 - RNA, 1671 nt, Artificial Sequence
  derived and/or modified sequence opt3 from capsid_protein__Norovirus__CAR95870
augaagauggccagcuccgacgcugcacccucuaccgauggcgccgggaaccuggugccugagucacagcaagaaguccucccacuugcgccgguugcuggagccgcacuggccgcucccgugguaggucagacaaauaucauugacccuuggauaaaagagaacuucgugcaggcaccacagggcgaauuuacugucagucccaagaauagcccuggggagaucuuggugaacuuagaacugggaccaaaacuaaaucccuaccucgaucaccuguccagaauguauaacucuuacgccggcgguauugacguuauggugguccuugcugggaaugccuucacggcgggaaaggugcugaucgcagccauuccuccaaacuuuccgguagagggcguuucggcuucacaagccacccaguucccccaugugaucauagaugucaggacauuggacccugugcggcucccacugcccgaugugcgcagcaccuuuuuccacuauacuaaugacacagagccuaaaaugcgacuggucaucuggcucuacaccccauuacguacuaacggcaguggggaugacuccuuuacaguuucuggaaggauucugaccagacccagccaggauuucgaauuugcauuccuuaucccgccuacgguggagacuaagaccacacccuuuuccguaccagguuucucagugcaggaaaugaguaauagccgguggccugcugccauuucugcgauggucgugcgcggcaacgagccccaaguugugcaguuucagaaugggagagcccauuuggacggaaugcugcuaggcacuaccccagucucccccaacuauaucgcaucauacagggguauaagcacagggaauagucggucugcuuccagcgaggccgaugaacgcgcugugggaucguucgacguauggguucgacuccaggagccugacggccaaccauaugauauuuucggcaagcagccggcccccaucgggaccccugacuuuaaagcagugauugucggauucgccgcuagaccacugacgucugguuccuacgcgaacgaagcauacgugaacacuacagccucagauuaugcucccgccaccggcaauaugagguuuacuguccggaacgggggaacaggccacaucagugcaaauaaguacugggaguucaaauccuuugguguggaaggggagcgucauaccaacauccaguaucaagaguacgaacuuccugacuauagcggccagguugccucuaaucacaaccuggcuccacccguggccccgcgcaugccuggagagagcuugcuccuguuccagucaaauaugccaguaugggaugacggccacggggaaaguacgcccaagaaaauucauugcuuacugccucaggaguuuauaggacacuucuuugauaagcaagcacccucccucggugacgcggcccuucugagauacgucaaccaggaaaccaauaggguguuguucgaguguaagcuauaucgggauggcuacaucacaguugcugcaagcucugggcugcucgacuuuccacuggauggauucuuucgauucgacucaugggugaguagcuucuacauucuuuccccugucggcucuggucaggggcgcagaggcagggugcgguuucaguga

SEQ ID NO: 19601 - RNA, 1623 nt, Artificial Sequence; identical to SEQ ID NO: 18747
  derived and/or modified sequence opt3 from capsid_protein_VP1__Norovirus__ADB27914

SEQ ID NO: 19602 - RNA, 1623 nt, Artificial Sequence; identical to SEQ ID NO: 17645
  derived and/or modified sequence opt3 from capsid_protein_VP1__Norovirus__ADI45809

SEQ ID NO: 19603 - RNA, 1623 nt, Artificial Sequence; identical to SEQ ID NO: 18202
  derived and/or modified sequence opt3 from capsid_protein_VP1__Norovirus__ADI45810

SEQ ID NO: 19604 - RNA, 1623 nt, Artificial Sequence; identical to SEQ ID NO: 17646
  derived and/or modified sequence opt3 from capsid_protein_VP1__Norovirus__ADI45813

SEQ ID NO: 19605 - RNA, 1608 nt, Artificial Sequence; identical to SEQ ID NO: 17868
  derived and/or modified sequence opt3 from capsid_protein_VP1__Norovirus__ADT70684

SEQ ID NO: 19606 - RNA, 1608 nt, Artificial Sequence; identical to SEQ ID NO: 18147
  derived and/or modified sequence opt3 from capsid_protein_VP1__Norovirus__ADZ24003

SEQ ID NO: 19607 - RNA, 1623 nt, Artificial Sequence; identical to SEQ ID NO: 17866
  derived and/or modified sequence opt3 from capsid_protein_VP1__Norovirus__AFI08234

SEQ ID NO: 19608 - RNA, 1623 nt, Artificial Sequence; identical to SEQ ID NO: 17655
  derived and/or modified sequence opt3 from capsid_protein_VP1__Norovirus__AFI08237

SEQ ID NO: 19609 - RNA, 1623 nt, Artificial Sequence; identical to SEQ ID NO: 17690
  derived and/or modified sequence opt3 from capsid_protein_VP1__Norovirus__AFI08243

SEQ ID NO: 19610 - RNA, 1593 nt, Artificial Sequence; identical to SEQ ID NO: 17803
  derived and/or modified sequence opt3 from capsid_protein_VP1__Norovirus__AFJ38516

SEQ ID NO: 19611 - RNA, 1620 nt, Artificial Sequence; identical to SEQ ID NO: 18096
  derived and/or modified sequence opt3 from capsid_protein_VP1__Norovirus__AFJ38519

SEQ ID NO: 19612 - RNA, 1623 nt, Artificial Sequence; identical to SEQ ID NO: 17660
  derived and/or modified sequence opt3 from capsid_protein_VP1__Norovirus__AFW15937

SEQ ID NO: 19613 - RNA, 1623 nt, Artificial Sequence; identical to SEQ ID NO: 17659
  derived and/or modified sequence opt3 from capsid_protein_VP1__Norovirus__AFW15939

SEQ ID NO: 19614 - RNA, 1623 nt, Artificial Sequence; identical to SEQ ID NO: 18261
  derived and/or modified sequence opt3 from capsid_protein_VP1__Norovirus__AFW15942

SEQ ID NO: 19615 - RNA, 1623 nt, Artificial Sequence; identical to SEQ ID NO: 17661
  derived and/or modified sequence opt3 from capsid_protein_VP1__Norovirus__AFW15943

SEQ ID NO: 19616 - RNA, 1623 nt, Artificial Sequence; identical to SEQ ID NO: 17662
  derived and/or modified sequence opt3 from capsid_protein_VP1__Norovirus__AFW15946

SEQ ID NO: 19617 - RNA, 1647 nt, Artificial Sequence; identical to SEQ ID NO: 18245
  derived and/or modified sequence opt3 from capsid_protein_VP1__Norovirus__AFX71656

SEQ ID NO: 19618 - RNA, 1629 nt, Artificial Sequence; identical to SEQ ID NO: 18243
  derived and/or modified sequence opt3 from capsid_protein_VP1__Norovirus__AFX71659

SEQ ID NO: 19619 - RNA, 1623 nt, Artificial Sequence; identical to SEQ ID NO: 17688
  derived and/or modified sequence opt3 from capsid_protein_VP1__Norovirus__AFX81124

SEQ ID NO: 19620 - RNA, 1623 nt, Artificial Sequence; identical to SEQ ID NO: 17709
  derived and/or modified sequence opt3 from capsid_protein_VP1__Norovirus__AFX81133

SEQ ID NO: 19621 - RNA, 1623 nt, Artificial Sequence; identical to SEQ ID NO: 17857
  derived and/or modified sequence opt3 from capsid_protein_VP1__Norovirus__AFX81151

SEQ ID NO: 19622 - RNA, 1623 nt, Artificial Sequence; identical to SEQ ID NO: 17908
  derived and/or modified sequence opt3 from capsid_protein_VP1__Norovirus__AFX81160

SEQ ID NO: 19623 - RNA, 1623 nt, Artificial Sequence; identical to SEQ ID NO: 17790
  derived and/or modified sequence opt3 from capsid_protein_VP1__Norovirus__AFX81175

SEQ ID NO: 19624 - RNA, 1623 nt, Artificial Sequence; identical to SEQ ID NO: 17705
  derived and/or modified sequence opt3 from capsid_protein_VP1__Norovirus__AFX81184

SEQ ID NO: 19625 - RNA, 1623 nt, Artificial Sequence; identical to SEQ ID NO: 17742
  derived and/or modified sequence opt3 from capsid_protein_VP1__Norovirus__AFX81187

SEQ ID NO: 19626 - RNA, 1623 nt, Artificial Sequence; identical to SEQ ID NO: 17949
  derived and/or modified sequence opt3 from capsid_protein_VP1__Norovirus__AFX81217

SEQ ID NO: 19627 - RNA, 1623 nt, Artificial Sequence; identical to SEQ ID NO: 17939
  derived and/or modified sequence opt3 from capsid_protein_VP1__Norovirus__AFX81220

SEQ ID NO: 19628 - RNA, 1623 nt, Artificial Sequence; identical to SEQ ID NO: 17761
  derived and/or modified sequence opt3 from capsid_protein_VP1__Norovirus__AFX81223

SEQ ID NO: 19629 - RNA, 1623 nt, Artificial Sequence; identical to SEQ ID NO: 17698
  derived and/or modified sequence opt3 from capsid_protein_VP1__Norovirus__AFX81235

SEQ ID NO: 19630 - RNA, 1623 nt, Artificial Sequence; identical to SEQ ID NO: 17740
  derived and/or modified sequence opt3 from capsid_protein_VP1__Norovirus__AFX81259

SEQ ID NO: 19631 - RNA, 1623 nt, Artificial Sequence; identical to SEQ ID NO: 17729
  derived and/or modified sequence opt3 from capsid_protein_VP1__Norovirus__AFX81280

SEQ ID NO: 19632 - RNA, 1623 nt, Artificial Sequence; identical to SEQ ID NO: 17881
  derived and/or modified sequence opt3 from capsid_protein_VP1__Norovirus__AFX81286

SEQ ID NO: 19633 - RNA, 1623 nt, Artificial Sequence; identical to SEQ ID NO: 17737
  derived and/or modified sequence opt3 from capsid_protein_VP1__Norovirus__AFX81310

SEQ ID NO: 19634 - RNA, 1623 nt, Artificial Sequence; identical to SEQ ID NO: 17958
  derived and/or modified sequence opt3 from capsid_protein_VP1__Norovirus__AGE89469

SEQ ID NO: 19635 - RNA, 1623 nt, Artificial Sequence; identical to SEQ ID NO: 17922
  derived and/or modified sequence opt3 from capsid_protein_VP1__Norovirus__AGE89484

SEQ ID NO: 19636 - RNA, 1623 nt, Artificial Sequence; identical to SEQ ID NO: 17759
  derived and/or modified sequence opt3 from capsid_protein_VP1__Norovirus__AGE89487

SEQ ID NO: 19637 - RNA, 1623 nt, Artificial Sequence; identical to SEQ ID NO: 17795
  derived and/or modified sequence opt3 from capsid_protein_VP1__Norovirus__AGE89619

SEQ ID NO: 19638 - RNA, 1623 nt, Artificial Sequence; identical to SEQ ID NO: 17904
  derived and/or modified sequence opt3 from capsid_protein_VP1__Norovirus__AGE89670

SEQ ID NO: 19639 - RNA, 1623 nt, Artificial Sequence; identical to SEQ ID NO: 17798
  derived and/or modified sequence opt3 from capsid_protein_VP1__Norovirus__AGE99596

SEQ ID NO: 19640 - RNA, 1653 nt, Artificial Sequence; identical to SEQ ID NO: 18241
  derived and/or modified sequence opt3 from capsid_protein_VP1__Norovirus__AGE99599

SEQ ID NO: 19641 - RNA, 1620 nt, Artificial Sequence; identical to SEQ ID NO: 18045
  derived and/or modified sequence opt3 from capsid_protein_VP1__Norovirus__AGE99612

SEQ ID NO: 19642 - RNA, 1647 nt, Artificial Sequence; identical to SEQ ID NO: 18246
  derived and/or modified sequence opt3 from capsid_protein_VP1__Norovirus__AGI17609

SEQ ID NO: 19643 - RNA, 1593 nt, Artificial Sequence; identical to SEQ ID NO: 17804
  derived and/or modified sequence opt3 from capsid_protein_VP1__Norovirus__AGM33211

SEQ ID NO: 19644 - RNA, 1593 nt, Artificial Sequence; identical to SEQ ID NO: 17809
  derived and/or modified sequence opt3 from capsid_protein_VP1__Norovirus__AGM33223

SEQ ID NO: 19645 - RNA, 1623 nt, Artificial Sequence; identical to SEQ ID NO: 17839
  derived and/or modified sequence opt3 from capsid_protein_VP1__Norovirus__AGT17839

SEQ ID NO: 19646 - RNA, 1617 nt, Artificial Sequence; identical to SEQ ID NO: 17838
  derived and/or modified sequence opt3 from capsid_protein_VP1__Norovirus__AGX85910

SEQ ID NO: 19647 - RNA, 1623 nt, Artificial Sequence; identical to SEQ ID NO: 18309
  derived and/or modified sequence opt3 from capsid_protein_VP1__Norovirus__AHI59162

SEQ ID NO: 19648 - RNA, 1620 nt, Artificial Sequence; identical to SEQ ID NO: 18266
  derived and/or modified sequence opt3 from capsid_protein_VP1__Norovirus__AHI59165

SEQ ID NO: 19649 - RNA, 1623 nt, Artificial Sequence; identical to SEQ ID NO: 17855
  derived and/or modified sequence opt3 from capsid_protein_VP1__Norovirus__AHX22044

SEQ ID NO: 19650 - RNA, 1623 nt, Artificial Sequence; identical to SEQ ID NO: 17888
  derived and/or modified sequence opt3 from capsid_protein_VP1__Norovirus__AII02587

SEQ ID NO: 19651 - RNA, 1647 nt, Artificial Sequence; identical to SEQ ID NO: 17873
  derived and/or modified sequence opt3 from capsid_protein_VP1__Norovirus__AII02617

SEQ ID NO: 19652 - RNA, 1647 nt, Artificial Sequence; identical to SEQ ID NO: 17961
  derived and/or modified sequence opt3 from capsid_protein_VP1__Norovirus__AIS24556

SEQ ID NO: 19653 - RNA, 1623 nt, Artificial Sequence; identical to SEQ ID NO: 18138
  derived and/or modified sequence opt3 from capsid_protein_VP1__Norovirus__BAI49908

SEQ ID NO: 19654 - RNA, 1623 nt, Artificial Sequence; identical to SEQ ID NO: 17975
  derived and/or modified sequence opt3 from capsid_protein_VP1__Norovirus__BAI49913

SEQ ID NO: 19655 - RNA, 1623 nt, Artificial Sequence; identical to SEQ ID NO: 17982
  derived and/or modified sequence opt3 from capsid_protein_VP1__Norovirus__BAI49922

SEQ ID NO: 19656 - RNA, 1608 nt, Artificial Sequence; identical to SEQ ID NO: 17990
  derived and/or modified sequence opt3 from capsid_protein_VP1__Norovirus__BAJ25074

SEQ ID NO: 19657 - RNA, 1617 nt, Artificial Sequence; identical to SEQ ID NO: 18000
  derived and/or modified sequence opt3 from capsid_protein_VP1__Norovirus__BAP33934

SEQ ID NO: 19658 - RNA, 1623 nt, Artificial Sequence
  derived and/or modified sequence opt3 from major_capsid_protein__Norovirus__ABQ63283
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucguguucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaagaugucuucaccguuagcugcagagugcugacaaggccgaguccugacuuugauuucaucuuucucguacccccaaccguggagucccggacuaaaccuuucucuguccccauuuuaacaguggaagagaugaccaauagccgcuuuccaaucccccuggagaaacuuuucacgggaccuuccucaacuauaguugugcagccacagaacgguagauguaccacagacggcgucuugcuggggacuacccaacuaaguccggugaauauuugcacauucaggggagauguaacccauaucgcgggcacgcaggaauacacuaugaaccucgccagccagaauuggaacaauuaugaccccacagaggaaauuccugcaccacuggguacccccgauuuuguugggaagauccagggagugcuuacucaaacaacccggcgcgacggcucuacgcgaggccacaaggcuaccgucuccacagggucagugaacuucacuccuaagcugggaagaauccaguuuagcaccgacacaaguaaugauuucgagacuggucagucuaccagguuuacaccagucggcgugguucaagacggguccaccacucaucagaacgaaccccagcaguggguguugccggauuacagcggacgggacucgcacaauguacaccucgccccugcugucgccccaucuuuccccggcgagcaacuguuauuuuuccguuccacgaugccugguuguucaggguaccccaacaugaaucuggauugccuccuuccacaggagugggugcagcauuuuuaucaggaagcagccccugcucaaagugacguugcgcuguugcgcuucgugaaccccgauacaggcagaguccuauuugaguguaaacugcacaagagcggauacgugaccguagcacauacuggccagcacgaccucgugauuccaccgaauggguauuucagguuugauuccuggguuaaccaguucuacacccuggccccuaugggaaacgguacaggccggcgacgcgcucuuuga

SEQ ID NO: 19659 - RNA, 1623 nt, Artificial Sequence
  derived and/or modified sequence opt3 from major_capsid_protein__Norovirus__ABV55634
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaaguggaauaaguaugacccgacggaagagauucccgccccucuugggacuccagauuucguaggaaagauccagggcguucugacacagaccacuaaaggcgacgggagcacacgcggacacaaggcuaccaucuacacggguucugcccccuuuaccccuaaauugggcuccgugcaguucucaacagacacugaaaacgauuuugagacccaucaaaauacaaaguucacuccagucggggugacccaggacggaagcacaacccaccgaaacgaaccccagcaauggguccucccgaguuacucuggcagaaaugugcacaacguucaucuggccccugcaguggcuccaacuuuucccggugagcaguuacuguucuuuagguccacgaugccuggguguagcggcuaucccaauauggaucucgacugccuucugccacaggaguggguacagcacuucuaccaagaagcggccccugcacagucggaugucgcuuugcuacgguuugugaaccccgacacaggacguguucuguucgaguguaaacuccauaagucuggcuaugugaccgucgcccacacugggcagcacgaucuggugauuccaccgaauggauacuuucgcuucgacuccuggguaaaccaguucuauacccuugcaccuauggguaacggcacagggagaaggcgggcccuguga

SEQ ID NO: 19660 - RNA, 1623 nt, Artificial Sequence
  derived and/or modified sequence opt3 from major_capsid_protein__Norovirus__ACV41093
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggagcaacuacgauccgacugaggaaauucccgccccucuggguacaccagacuuuguagggaagauccagggaaugcuuacccagacuacaggccgagacggcucuaccagagggcacaaagcuacgguucugaccggauccgccgauuucgcacccaaguuggguagggugcaauuugccacagacacugauaaugacuucgagucaggcgaaaacaccaaguuuacaccugucggggugauccaggauggaagcacuacccaucggaaugagccacagcaauggguccuccccaacuacaguggccguacaggucacaaugugcaccuggcuccggcgguugcaccuaccuauccaggggaacaguuacuguucuuucgcucuacuaugcccggcuguuccggauacccuaacauggaccucgauugccuucugccccaggagugggugagacauuucuaucaggaggccgcuccagcccaaagcgacguagcauugcuaagguuugucaauccugauacgggccgggugcuguucgaauguaaacuccacaagcccggguacguuacaguggcccauaccggacagcacgaccuggucauuccaccgaacgguuauuuucgauucgauucgugggugaaccaguuuuacacucuugcuccuaugggcaaugggaccggacgcagaagggcccuguga

SEQ ID NO: 19661 - RNA, 1635 nt, Artificial Sequence
  derived and/or modified sequence opt3 from major_capsid_protein__Norovirus__ACV41096
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaacgcgucuugaaccucacugagcuggacgggagcccauucauggcauucgcugccccggcgcccgccggauuuccugauuuagguucuugcgacuggcacauugagauguccaaaaucccaaauucaagcacacagaacaaucccauugugguaaacaguguuaagccuaauucucagcaguucgugccacaucuguccagcaucacccucgaugacaacgucucgucuggcggggauuacaucggaacgauucaauggaccucucccccgucagacaguggcggugcaaauacaaacuuuuggaagauaccugauuaugggagcucccuugcugaagccucucagcuggcuccagccguguaucccccuggcuucaaugaggucaucguguacuuuauggcaagcauucccggaccaaaccagucaggcaguccuaauuugguucccugucuacugccacaggaauacaucacucacuucauauccgagcaagccccgauucagggggaggcugcgcuccugcacuacguggacccugauaccaaccgaaaucuuggagaauuuaaacuguaucccgguggcuacuugacaugcguaccaaacagcuccucaacugggccccagcagcucccucuggacggagucuucguguuugcaaguuggguuagcagauucuaucaauuaaagccagugggcaccgccggucccgcuagggggcggcugggcguccgucgcuga

SEQ ID NO: 19662 - RNA, 1743 nt, Artificial Sequence
  derived and/or modified sequence opt3 from major_capsid_protein__Norovirus__ACV88130
augaagauggccagcaacgacgcuaccgcacccucccaggauggcgccgcgaaucuggugccugaaucucaacacgaaguccucgcucuugagccaguugccggggcagcccuggcugcaccgguggccggacaguucaacgcuaucgaccccuggauuaaacagaauuuuguacaggccccugcgggugaguucacagugucaccaagaaacgcacccggcgaaauauugauggauuuagaacuggggccugagcuaaguccauuucucgcccaucuggcucaaauguacaaugccuaugcaggaggcauggagguccagaucauucuugcugguaacgccuucacugcggggaagaucauugugugcgccguucccccuaauuuuccaccggacaggcugagcgcaucccaggcuacgaacuucccccacgugaucauggauguccggaccuuggaaccugugauacucccacugcccgacguacgcgccggauuuuuccauuacaaucagcugcgagagccucguaugagacucauggcuuuacuguauacaccacuuagggccaacggcacuggcgaugacgcauuuaccguuucuugucggguguugacacgccccaugcaagauuucgaauuuauguuccuggucccgccuaccguggagucgagagugacucccuuuucagucccaacauacccuguuguggagaugaccaauaguagguggcccgcccggaucagcgggaugcacguaaacgcuaaucagacgcuagcggugcaguuccagaacggacgcugcacucucgacggucaacugaugggcaccacacagcuuugugcagccgaugucugccgaaugagagggagguauacuuccacccgggcugaccuggccggaguggaucauacagaccagggcccaucuuugggugcagggcccagcaaugacccuguuuccgugccagaagcccguucacaaacccgcacgagugucagcgcucaccuccagcuggaggaauuaaacggacagccguacgagguguauggcgaacagcccgccccucugggcacuccagauuucuguugcagacucaugggggagcuuguaaggcugcccucuacauccccugcagcgcaaucacgguuucgagacgcuuucuuugauaccuacggagccuuguucgcaccagccguugguagcacuacauuuaccgugaacaauaguucuacguccgacuucgcuaacggccagcccuuugaguuccuaccgauuggggucgaaaucggaaauagcgcccaguacgaugaguuugcacugccuucguauaacggcgcuauuggugaaaaucgccaccucgccccaguggcggcccccggguucccuggcgagaacaucgucuuuuucucuuccaaucugcccgugugggacucaaccagugcucagaacaauagaaggauaagcugucuucugccaaacgaauuuguucaacauuucuacgauuugcaggcaccuucccagucugacguggcccuccugcgguauguacaccccgagagcggacgcgucuuauucgagugcaaacuguacagagauggcuuucuaacagugaauggggcuucacucgccgaguucccaguuaacggauauuuuagguucgacaguugggugaaucaguuuuucacucuguccccggucgguaccggcagcgggcguucuggacggucacgaaacgcacaauga

SEQ ID NO: 19663 - RNA, 1623 nt, Artificial Sequence; identical to SEQ ID NO: 18809
  derived and/or modified sequence opt3 from major_capsid_protein__Norovirus__ACW19927

SEQ ID NO: 19664 - RNA, 1623 nt, Artificial Sequence
  derived and/or modified sequence opt3 from major_capsid_protein__Norovirus__ACX31885
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggaacaauuacgauccgacugaggaaauucccgccccucuggguacaccagacuuuguagggaagauccagggaaugcuuacccagacuacacgaagcgacggcucuaccagaggccacaaagcuacgguucugaccggguccgccgauuucgcacccaaguugggaagggugcaauuugccacagacacugauaacgacuucgagucaggucagaauaccaaguuuacaccugucggcgugauccaggaugggagcacuacccaucggaacgaaccacaacaguggguccuccccaauuacaguggacguacaggccacaacgugcaccuggcuccggcgguugcaccuaccuauccaggugagcaguuacuguucuuucgcucuacuaugcccggguguuccggcuacccuaauauggaccucgauugccuucugccccaggaaugggugcaacauuucuaucaggaggccgcuccagcccagagcgacguagcauugcuaagauuugucaacccugauacgggaagggugcuguucgaguguaaacuccacaagucgggcuacguuacaguggcccauaccgggcagcacgaccuggucauucccccaaacggauauuuucgguucgauucuugggugaaucaauuuuacacucuugcuccgauggguaacggcaccgggcgacgcagagcccuguga

SEQ ID NO: 19665 - RNA, 1623 nt, Artificial Sequence
  derived and/or modified sequence opt3 from major_capsid_protein__Norovirus__ACX31887
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaauuacaguggcagaaacguuccuaaugugcaccuggcaccagccguagcucccaccuuuccuggugagcaguuacuguucuuuaggucuacuaugcccggguguuccggcuauccaaacauggaucucgacugccuucugccucaggaguggguccagcauuucuaccaagaagcggcacccgcccagagcgauguggcuuugcuacgguuuguuaacccagacacgggacgugugcuguucgaguguaaacuccacaagucgggcuaugucacaguggcccauaccgggcagcacgaucugguaauuccgucuaauggauacuuucgcuucgacuccugggugaaccaguucuauacucuugcaccuauggguaauggcaccgggagaaggcgggcccuguga

SEQ ID NO: 19666 - RNA, 1623 nt, Artificial Sequence
  derived and/or modified sequence opt3 from major_capsid_protein__Norovirus__ACX31891
augaagauggccagcuccgacgcuucucccucagauggcagugcagccaaccuggugccugaggucaauaacgaaguuauggcgcucgagccagugguaggggcugccaucgcagccccgguggcuggacagcaaaauauuauagaccccuggaucagaaacaauuucguccaggcaccugguggcgaauuuaccgugagcccaaggaacgcccccggggagauucuuugguccgcuccucugggaccagauuugaaucccuacuuaucucaccugucgcggauguauaacggcuacgccgguggguucgaaguucaggugauccuagcgggaaaugcauuuacagccggcaaagucauuuucgcugccgugccuccaaacuuuccgacugagggccucucacccagccagguaacgauguucccucauaucauaguugacgugcgccaacuggagccaguccuuaucccccugccugaugugcgaaauaacuuuuaucacuacaaucagaccaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucacagugcccaucuuaaccgucgaggaaaugacgaacagccgcuuuccaauaccccuggagagacuuuacacuggaccuuccucagcguucgugguucagccacagaaugguagguguaccacagauggcguguugcuggggacuacccaacuaagugccgucaacauuugcacauuccggggagacgugacccauaucacgggcagccgcaauuauacuaugaaccucgcaucucagaauuggaacaauuacgauccgacagaggaaauucccgcuccucuggguaccccagacuuuguagggaagauccagggaaugcuuacucagacaacccgaggcgacggcuccacgagagggcacaaagccaccguuuacacaggaucagcugauuucgcccccaagcuggguagggugcaauuugcaacugacaccgauaacgacuucgagagcaaucagaacacaaaguuuacuccugucggcgugauccaggaugggaauaccacacaucaaaacgaaccacagcagugggucuugcccggauauaguggccgggacggucacaaugugcaccucgccccggcuguugcgccuaccuacccaggggagcagcuguuauucuuucguucuacuaugcccggcuguuccggauauccuaacaugaaucuggauugccuccuuccccaagaaugggugcagcauuucuaccaggaggcagccccagcucagagcgagguagcccuguugcgcuuugucaacccugacacgggcagagugcuauucgaauguaaacugcacaagucgggguauguuacaguggcacauaccggacaacacgaucucgucauucccccaaacgguuacuuuagguucgacucuugggugaaucaguuuuauacucuggccccgaugggcaacggggcuggacggcgacgcgcccuuuga

SEQ ID NO: 19667 - RNA, 1623 nt, Artificial Sequence
  derived and/or modified sequence opt3 from major_capsid_protein__Norovirus__ACZ37232
augaagauggccagcaacgacgcugcacccuccaaugauggcgccgcggggcuggugccugaaaucaacaaugaagucaugccacucgagccgguugcuggagccucucuugcaacccccgugguaggucagcaaaacauuauagacccuuggaucagaaauaacuucgugcaggccccagcuggcgaauuuacagucucacccaggaauaguccuggggagauucuguuggauuuagaacugggaccagagcuaaaccccuaccucgcacaccuggcccggauguauaauggccaugcuggugggauggaggugcagaucguucuugccggaaacgcguucacugcaggcaaaauuaucuuugccgcuauaccuccaggcuucccguacgaaaaucugagccccucccagaucacgaugugcccucacgugauuaucgacguccgccaauuggagccagugcuccugcccaugccugauauucgaaacaacuuuuuccauuauaaucaggggaaugacccaaagcugcgucucguagccauguuauacacaccccugagagcaaacaacucuggagaugacguuuuuaccgugucguguaggguccuuacuaaaccgucaccugauuucgaauuuaccuucuuggugcccccaacaguggagagcaagaccaaacaguuuacucugccuauccuaaagauaagugagaugacaaauucccgguuccccgucccaguugaaaugauguauaccgcucgcaacgagaaucaggugguacaaccccagaacgguagagugacgcucgacggcgaacugcuugggacuaccccucuguuggccgucaauauuugcaaguuuaaaggagaggugaucgcgaagaacggcgauguuaggucuuaccggauggacauggaaauuacaaauacugaugguaccccaaucgacccgacagaggacacccccgggccuaucggaagcccagauuuccagggcauucucuucggcguggccucccagcgcaacacgaaugagcccaacccugcaacucgagcucacgaagccaauauaaacacagggggagaccaauaugcuccaaaacuggcccaggucaaguuuuucucagagagucaggauuuugaagugcaucaacccaccguauucacuccgguugguguggcaggcgacacaagccacccuuuuagacagugggucuuaccaagguacgggggacaccugaccaauaacacgcaucucgcccccgcuguggcgccucuuuuccccggcgagcagauccuguuuuuccggucucagauuccauccucaggugggcacgaauugggcuacauggauugucuagucccucaagagugggugcagcauuuuuaucaggaggcagccaccgcucagagcgaaguugcccugauccguuucauaaaucccgacacaggacgcgugcucuuugaggcaaaacugcacaagcaaggcuucauuacuguagcccacaccggggauaacccaaucgucaugccgccuaacggauacuuuagauucgaggcuugggugaaucaguucuauagucuugcccccguugguacaggcaacgggaggcggcgaauccaguga

SEQ ID NO: 19668 - RNA, 1623 nt, Artificial Sequence; identical to SEQ ID NO: 17662
  derived and/or modified sequence opt3 from major_capsid_protein__Norovirus__ADD10375

SEQ ID NO: 19669 - RNA, 1623 nt, Artificial Sequence
  derived and/or modified sequence opt3 from major_capsid_protein__Norovirus__ADO85552
augaagauggccagcuccgacgcuaaccccucugauggcucaaccgcaaaucuggugccugaggucaacaaugaaguuauggcccucgagccagugguaggggcggcuagugccgcaccgguggccggacagcaaaacgucaucgaccccuggauuagaaauaacuucgugcaggcuccugguggcgaauuuacagagagcccaacuaaugcacccggggaaauacuuugguccgccccucugggaccagauuugaaccccuacuuaucucaccuggcuaggauguauaauggcuacgccgguggguucgagguucaggugauccuagcgggaaacgcauuuacggccggcaaaauuaucuucgcugccgucccuccaaauuuuccgaccgagggccucucgcccucacaggugacaauguucccucauauuaucguagacguucggcaacuggaaccagugcuuauaccccugccugauguccgcaacaauuuuuaucacuacaaccagagcaaugacccaacuaucaaguugauugcaaugcucuauacgccccugcgagcuaacaacgccggggaugacguguucacagugaguugccguguccugaccagaccguccccugauuuugacuucaucuuucucguucccgcgacuguggagucuaggacaaaaccauucagcguaccuguguuaaccgucgaagagaugaccaauucccgguuucccauuccacuggagaaacuuuucacuggacccucaagugccuucgugguucagccucagaacggucgcuguaccacagauggcguguugcuggggacuacccaacuaagcccagucaauaucugcacauuuagaggagacgugacccauauaccgggcucuaggaacuacacgaugaaucucgcaucccagaacuggaacucauaugaucccacugaagagauuccugcuccaguagguacacccgacuucguugggaagauccagggagugcugacccagacuacacggaccaauggcagcacgcgcggccacaaggccaccgucuacacagggagugcugacuuuucuccuaaacuuggacgagugcaauucgccacugauaccgacaaugauuuugaaacaaaccagaauacuaaguucaccccagucggugugauucaggacggcuccacaacccccagaaacgagccgcaacaguggguucugccuagcuacucggggaggaauauccauaacgugcacuuggcaccagccguagcucccacuuuuccuggagaacagcuccuguucuuucggucuacgaugcccggcuguuccgguuauccaaauauggauuuagacugccugcucccucaggaguggguccaauacuucuaucaggaggcggcacccgcccagucagauguggcccuucugcguuuuguuaacccagacacagggcgcguguuguucgaauguaagcuacacaaaaguggcuacgucaccguggcucauacuggacagcacgaucugguaaucccgccuaacggcuauuuuagauucgacagcugggugaaucaauucuacacccucgcacccauggggaacggaacagguaggcggcgagcccuguga

SEQ ID NO: 19670 - RNA, 1623 nt, Artificial Sequence
  derived and/or modified sequence opt3 from major_capsid_protein__Norovirus__ADQ43779
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggcacucccgucuuacuccggcagaaacgugcagaauguucaccuggccccugcuguggcgccaaccuuucccggugagcaguuacuguucuuuaggagcacuaugccuggguguucgggcuaucccaacauggaucucgacugccuucugccacaggaguggguacaacauuucuaccaggaagcagccccugcucagucugaugucgccuugcuacgguuugugaaucccgacacgggacguguucuguucgaguguaaacuccacaaguccggcuaugugacagucgcacauaccgggcagcacgaucuggugauuccaccgaacggauacuuucgcuucgacucauggguaaaccaauucuauacucuugccccuauggguaauggcaccgggagaaggcgggcucuguga

SEQ ID NO: 19671 - RNA, 1623 nt, Artificial Sequence; identical to SEQ ID NO: 17702
  derived and/or modified sequence opt3 from major_capsid_protein__Norovirus__ADQ43781

SEQ ID NO: 19672 - RNA, 1623 nt, Artificial Sequence; identical to SEQ ID NO: 18202
  derived and/or modified sequence opt3 from major_capsid_protein__Norovirus__ADQ43783

SEQ ID NO: 19673 - RNA, 1623 nt, Artificial Sequence; identical to SEQ ID NO: 18202
  derived and/or modified sequence opt3 from major_capsid_protein__Norovirus__ADV37805

SEQ ID NO: 19674 - RNA, 1623 nt, Artificial Sequence; identical to SEQ ID NO: 18202
  derived and/or modified sequence opt3 from major_capsid_protein__Norovirus__ADV37807

SEQ ID NO: 19675 - RNA, 1623 nt, Artificial Sequence; identical to SEQ ID NO: 18202
  derived and/or modified sequence opt3 from major_capsid_protein__Norovirus__ADV37809

SEQ ID NO: 19676 - RNA, 1623 nt, Artificial Sequence
  derived and/or modified sequence opt3 from major_capsid_protein__Norovirus__ADV37813
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuggagaccaaccagaauacaaaauuuacucccgucggugugauccaggacggcucuaccacaccgaggaacgaaccucaacaguggguucucccauccuacagcgggcggaauauccauaacgugcaccuggcccccgcaguagccccuaccuuccccggagagcaguuacuguuuuuccguucgacuaugccaggcuguucugguuauccuaauauggaucucgacugccuucugccccaggaauggguccaauacuuuuaucaggaggcugcgccagcacaguccgauguggccuugcuacgcuucguuaacccggacacggggagagugcuguuugaguguaagcuccacaaaucaggcuacgucacaguggcucauaccggacagcacgaucugguaauuccucccaacggcuauuucagguuugacaguugggugaaucaauucuacacucuugccccaauggggaacggaaccggucggcgacgcgcacuguga

SEQ ID NO: 19677 - RNA, 1623 nt, Artificial Sequence
  derived and/or modified sequence opt3 from major_capsid_protein__Norovirus__ADV37917
augaagauggccagcuccgacaccaaaacaucugauggcucaacugcuaaccuggugcccgaggucaauaacgaaguuauggcacucgagccugugguaggggccgcgaucgcugccccaguggcaggacagcaaaaugucauugacccguggauaagaaacaauuucgugcaggcccccgguggcgaauuuacgguuaguccuaggaacgcuccaggggagauccuuuggagcgcaccccugggaccugauuugaauccauacuuaucccaccuggcccggauguauaacggcuacgcugguggguucgaagugcaggucauucuagccggaaaugcguuuaccgcaggcaagaucauuuucgccgcugugcccccuaacuuuccaacagagggccucucuccgucgcagguaacuauguucccccauaucauaguugacgugcgccaacuggagccuguccuuaucccacugcccgaugugcgaaauaacuuuuaucacuacaaucagucaaacgacccuaccauuaaauugaucgccaugcucuauacaccacugcgugcaaauaacgcuggggaugacguguucaccgucagcugcagaguucugacuaggcccaguccggauuuugacuucauuuuucucgugccucccacaguagaaucccggaccaagccauucucugugccuaucuuaacggucgaggaaaugacuaacagccgcuuucccauaccacuggagaaacuuuucaccggacccuccucagccuucgugguucagccucagaaugguagauguacaauugauggcguguugcuggggacuacccaacuaaguccagucaacaucugcacauuuaggggagacgugacccauauuacgggcagccggaauuacacuaugaaccucgcgacacagaauuggaacucuuaugauccgaccgaggaaauccccgccccucuggguacuccagacuucguagggaagauccagggaguucuuacacagaccacgcgcgcagacggcuccacccgaggccacaaggcuacaguguacacugggucagccgauuuugcucccaaacugggaagaguccaauucgccaccgacacagauaaugacuuugaugcaaaccagaauacuaaguucaccccugugggugucauucaggacggcaacacagcccauaggaaugagccacaacaguggguguugcccagcuacagugggcggaacucucacaauguucaccucgcuccggcgguggcaccuaccuuuccaggagaacagcuguuauucuuucguuccacuaugcccggcuguagcgguuauccuaacauggaucuggacugccuccuuccccaggaguggguacaauacuucuaucaggaagccgcuccagcccagucggaugucgcacuguugcgcuuugugaauccugacacggggagaguucuauucgaguguaaacugcauaagucuggcuacgugacagucgcccacaccggacagcaugaucucgugauacccccaaacggcuauuuuagguucgacuccuggguaaaccaauucuacacucuggcuccgauggggaauggaaccggucggcgacgcgcccuuuga

SEQ ID NO: 19678 - RNA, 1623 nt, Artificial Sequence
  derived and/or modified sequence opt3 from major_capsid_protein__Norovirus__ADV37919
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuauugauggcguguugcuggggaccacacaacuaaguccggucaauaucugcacuuuuaggggagacgugacccauauuacaggcagccggaacuacaccaugaaucucgccacgcagaacuggaacucuuaugaucccacugaggaaaucccugcaccacuggguacacccgacuucguagggaagauccagggaguucuuacccagacuacacgcgcugacggcuccacccgaggccacaaggccacgguguacaccgggucagcugauuuugccccuaagcugggaagaguccaauucgcaacagacacugauaaugacuuugaugccaaucagaacaccaaauucacaccagugggugucauucaggacggcaauacugcucauaggaacgagccccaacaguggguguugccgagcuacagugggcguaauucucacaacguucaccucgcgccugcaguggccccaaccuuucccggagaacagcuguuauucuuucgguccacaaugccuggcuguagcgguuaucccaauauggaucuggacugccuccuuccacaggaguggguacaauacuucuaucaggaagcugccccugcacagucggaugucgcccuguugcgcuuugugaaccccgacaccgggagaguucuauucgaguguaagcugcauaaaucuggcuacgugacugucgcucacacgggacagcaugaucucgugauaccaccgaacggcuauuuuagguucgacuccuggguaaaucaauucuacacacuggccccuauggggaacggaaccggucggcgacgcgcacuuuga

SEQ ID NO: 19679 - RNA, 1608 nt, Artificial Sequence
  derived and/or modified sequence opt3 from major_capsid_protein__Norovirus__AEI83469
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuuagccggauguauaauggcuacgcuggugggguggagguucaggugcuguuggccggaaacgcguucacggcaggcaaacucgucuuugccgcugugcccccucauuucccacuggaaaauaucuccccgggccagauuaccauguuuccccacguaaucauugauguucgcacacuggagccugugcucuuaccacugcccgacguccgaaacaauuucuuucauuauaaccagcaaaacgaaccucguaugagacuuguggccauguuguacacuccacugaggucuaaugggucgggagaugacguguucaccgucucaugccggguucuaacacgccccagcccggauuuugacuucaacuaucucgugccucccaccguagagaguaagacuaaaccauuuacacugccuauccuuaccauaggugagcugacuaauuccagauuccccgugccaaucgaugaauuguacacgucucccaacgagagccucgucgugcagccucagaaugggaggugugcacuggacggcgaauuacagggaaccacacaacugcucccaacugcuauuugcuccuuucggggccgcaucaaccagaagguuucaggugagaaucacguguggaacaugcaggucaccaauauuaacgggacaccguucgaucccaccgaagacgugccugccccacuuggaacgcccgauuucaguggcaaacuguuuggcguauugagccagcgagaccaugacaaugcguguagaucucacgaugccguuaucgcaacuaacuccgcuaaguucacaccuaagcuaggggccauacaaauuggaaccugggaggaggacgaugugcacaucaaucagccaacuaaauuuacacccgucggucuguucgaaucagagggcuuuaaccaguggacccucccgaauuauagcggggcucugacgcuuaacaugggacuggccccuccaguggcacccaccuucccuggcgaacaaauuuuguuuuucaggagucauaucucucucaaggguggggucgccgaccccgugaucgauugccuguuaccacaggaguggauucagcaccuguaccaggaauccgcuccuagccaaacagacguugcgcuaauacgguuuacuaaccccgauaccggccguguacucuucgaggcaaaacugcaucgcucgggauacaucacaguggccaauacuggcucuagaccaauugucgugccggcuaacggguauuuuagguucgacuccuggguuaaucaguuuuacucacuugccccuaugggaaccgguaacggccggcgacgcgugcaguga

SEQ ID NO: 19680 - RNA, 1644 nt, Artificial Sequence
  derived and/or modified sequence opt3 from major_capsid_protein__Norovirus__AEP04093
augaagauggccagcaacgacgcugcacccuccaccgauggcucugccgggcuggugccugaggucaauaacgaaacaauggcgcucgagccaguugugggagcuccgcuugccgcacccguagccggucagcacaauaucauugacccuuggauaaaaaugaacuucgugcaagcuccaaauggcgaauuuacugucucacccagaaacgcaccuggggagauccuguuggauuuagaacugggaccagaccuaaaucccuaccucagucaucuggccaggauguauaacggcuacgcuggugggauggaggugcagguugugcuugccggaaaugcguucacggcaggcaagauuaucuuugccgcugucccuccaaacuucccggccgagaaucugagcgcagcucaggugaccaugugcccccacguaauuguugaugugcggcaguuggaaccugucaugcucccaaugcccgacauccgcaacaaacuguuucauuauaaucaaguggaugacccuaagcugcgacucuuagccuaccuguauacaccacuucgugcgaacaaugccggcgaugacguguucacugucuccuguagaguuuugaccaggcccacaccggauuuugaguucauguuucuggugccucccaccguagaaucuaaaacuaagccauucucgcuaccuucacucacacuggacgagcuuagcaacagucgguuucccgcaccaauagugcagcuguacaccaacccccacgauaauuuggucgugcagccucagaacgggcgcugcacgaucgacggacuccugcaagguacuacccaguuaguuuccuguaaugugugcucuuucagaggcacaauuggggacggacagccagcuagccauuccgaggaagagaucaugccgauggccuuuaacauucagagggaacugaugcucgagaaucuugauggcucacccuaugacccuacugaugacaucccagcuguccuggguagucccgauuuccaaggggugauauucggaauuuugagccagcggaacggcgacggccagacccgcgcccacgaagcaaagguagauacacgagccgcuagauuugcgccuaaacuaggguucguuguggcaaccgucgagucuacggacuuucacgccaaucaaccauccagguucacucccgugggacuggguggcgaugggaaccaggacuuugcucaguggaaucucccgacauacggaggcgcccugaccaacaauacuaaccuugcaccuccagucaugcccguguacccuggugagcagcuguuguucuuucggucacaacuccccagcagugggggcguugugggaggcuggcuggauuguuuacugccacaggaauggguacagcauuucuuucaggagucugccacaucccaaagcgacgucgcucuagugcguuauaucaauccuaccacggggcgcguucucuucgaagccaagcugcacaaacagggauuucuuaccguggcagcgucggguucuuaccccuuggucgugccagcugacggcuauuucagauuugaguccuggguaaaccaguucuacacacuggccccgauggggaauggaucaggcaggcggcgaacucgcuga

SEQ ID NO: 19681 - RNA, 1620 nt, Artificial Sequence
  derived and/or modified sequence opt3 from major_capsid_protein__Norovirus__AEQ77282
augaugauggccagcaaggacgcucccuccaacauggauggcaccucuggggcaggacagcuggugccugaggucaaugccgcggaaccacucccgcuugagcccguugugggugcugccacagcagccgcuacugcaggccaaguaaaccugaucgacccuuggauuaugaauaacuucgugcaggccccagaaggggaguuuacgauaucacccaauaacaccccuggagauaucuuguucgacuuacaccugggcccacaucuaaaucccuuucuccagcaccugagucagauguacaacgguugggucgggaauaugagagugaggguuaugcuugcuggaaacgccuucacagcgggcaaaauuaucauuugcugugugccuccaggcuuugcaagccaaaauaucuccauagggcaggccacuauguucccgcaugucaucgcugaugugcggguacuggaacccauugagaucccuuuggacgauguucgcaacgugcucuuucacaccaaugagaaccgaccaacaaugcgucugcugugcaugcucuauacccccuuaagagccggaggugcaucuucgggcacugacccuuucgucauugcugggagggugcugacauguccaucacccgauuuuaauuuccuuuucuuggugccgccuagcgucgaacagaagacccggcagcugacgguucccaacaucccacuaaacaaucucgccaacagucgcgugccugcgaugauaaauaaaaugacuguauccaccgaccaaaaccaggugguccaguuccagaauggaagaugcacacuggagggccaacuucuggguacuacccccgugucugccagccagguugcaaggauucgggggaagguguuuuccacagcuucaggaaaaggcuugaaccucaccgaacuggauggcacgccauaccaugccuucgagagucccgcuccuuuaggguucccagacaucggagccugugauuggcacgucagcacuuuuaagguggaccagaaucugucuggugacccgaugucccgccucgauguaaagcaaaacgcacccuucgccccucaccuuggcucaauugaguuuacaagcgaccaggauccaaccggggaccagcugggaacuuuggcuuggguuagucccucuacauccggcgcgcgaguggauccuuggaaaaucccaagcuaugguucgaccgucacggaaucuacccaucuagcacccccgaucuucccuccaggguuuggcgaggccauuguguacuucauguccgacuuucccauagucucaggaaauacagcucaggugccuugcacucugccccaagaauuuguuagucacuuuguggagcagcaggccccaguaagaggcgaagcagcccuccugcauuaugucgauccugacacccacaggaaccuuggggaguucaagcuguaccccgauggauuuaucacaugugugccaaauacugguggcgggccgcagaacuugccuaccaauggaguuuucguguuuagcuccugggucucucgguauuaccaacucaaacccgugggcacagcugguccagcccgucgccuggggguaagaaggguguga

SEQ ID NO: 19682 - RNA, 1608 nt, Artificial Sequence
  derived and/or modified sequence opt3 from major_capsid_protein__Norovirus__AFA55174
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagguccuguugaauuuagaacugggaccugagcuaaacccauuccucgcccaccugagccggauguacaauggcuaugcuggugggguggagguucaggugcuucuggccggaaacgcguuuacggcaggcaaauuggucuucgccgcuauucccccucauuuuccacucgaaaaucuguccccgggccagaucaccauguucccccacgugaucauugauguacgcacacuggagccuguucucuuaccacugcccgacgugcgaaacaacuuuuuccauuacaaucagcaaccugaaccacguaugagacuugucgccauguuguauacuccccugaggucuaacgggucgggagaugacguguuuaccgugucaugccggguccuaacacgcccgagcccugauuucgacuuuaauuaccucguucccccaaccguggagaguaagacuaaaccuuucacacugcccauccuuaccauaggugagcuguccaacucuagauuuccaguacccaucgaugaauuguauacgagcccuaaugagggcguggucgugcagccacagaacgggagguccacucucgacggagaacuguuaggcaccacacagcugguuccgucaaauauuugugcacuccggggucgcaucaacgcucaagugcccgaugaccaccaucaguggaaucuucaggucacuaacgccaaugggaccaguuucgauccuacagaggacgugccagcgccccugggaaccccugacuucuuggccaacauuuacggcguaacgagccagcgaaauccagauaacacuugcagagcacacgacggcguucuagcuacauggucucccaaguuuaccccgaaacugggguccgugguccucggaacuugggaagagucagaucuggaccuuaaucaaccuacaagguucaccccagugggucuguaugauacgggccacuuugaccagugggucuugcccaacuacagcgggcggcucacccugaauaugaacuuagccccuaguguggcuccccuguucccaggagagcagauccuauuuuuccguucucauauaccucucaagggcgguacauccaacggggccauugauugucugcuuccccaagaauggauccagcacuuuuaccaggagagcgcaccaucgccgacugacguugccuugauucgcuauaccaauccugauacaggcagagugcuguucgaagcuaagcuccauaggcagggauuuaucacuguagcgaacucuggcucccggcccaucgucgugccacccaauggguacuuccgauuugacucauggguuaaccaauucuauagucuggcaccuaugggaaccgguaauggccgcagaagggugcaguga

SEQ ID NO: 19683 - RNA, 1629 nt, Artificial Sequence
  derived and/or modified sequence opt3 from major_capsid_protein__Norovirus__AFC89656
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucuccauugagcagcuguacaccgccccuaacgagaauaacguugugcagugucagaaugggaggugcacacuugacggagaacugcaagguacuacccaguugcucucaagugcgguauguagcuaucggggccgcacaguggccaacucuggggauaauugggaccagaacguccugcaguuaaccuacccauccggagcaucauacgauccgacggacgaggugcccgcuccucugggcacucaagacuucagcgguauccucuaugggguucuuacacaggauaaugugcgagaaaacaccggagaggccaagaaugcuaaaggcgucuacaucaguacuacaucuggcaaguuuaccccaaagauuggguccauaggacugcauagcaucacggaagacgugagacccaaccagcaaucgagguucaccccuguagguguugcccagaaugagaacacaccauuccagcaguggguguugccccacuaugcaggcgcccuagcucugaauacuaaccucgcgccggcagucgccccuaccuuuccaggggagcaacugcuuuucuuucggucucgugugcccugcguccagggacugcagggccaggaugcuuucauugacuguuugcucccucaagaaugggugaaucauuuuuaccaggaggccgcacccucccaggccgauguugcucugauccgcuaugugaacccagacacagguagaacuuuauucgaagccaaacugcacaggucaggguuuauaaccguaagucacacaggcgcauacccucuagucgugcccccaaacggacauuuccgguuugauagcuggguuaaucaguucuauucccucgcgccgaugggcaccgggaacggacgacgcagagugcaauga

SEQ ID NO: 19684 - RNA, 1617 nt, Artificial Sequence
  derived and/or modified sequence opt3 from major_capsid_protein__Norovirus__AFC89659
augaugauggccagcaaggacgcucccuccaacauggauggcaccucuggggcaggacagcuggugccugaggucaauacagccgaaccacucccgcuugagcccguugugggugcggcuacugccgcagccacggcuggccaaguaaaccugaucgacccuuggauuaugaauaacuucgugcaggcaccagaaggggaguuuaccauaucacccaauaacacaccuggagauaucuuguucgacuuaagacugggcccacaccuaaaucccuuucuccugcaucuuagucagauguacaacgguugggucgggaauaugaggauucgggugaugcuggccggaaacgcuuucagcgccggcaaaaucauuaucugcuguguuccuccaggcuuugaaucccagaauauaucuaucgggcaagcgacuauguucccgcacgugauugcagauguccgcguguuggagcccaucgagauuccucucgacgauguacgaaacguucuguaucauaccaaugaaaaccguccaacaaugagacugcucugcauguuauacacccccuugagggccggaggugcuucgucaggcacugacccuuuugugaucgccgggcggguccuuacauguccagcacccgauuucaauuuucuguuccuggugccgccuagcguggagcagaagacccgccagcuaacgauacccaacauuccacucaacaaucuggcuaacaguagagucccugccaugaucaauaaaauggcgguuuccgccgaccagaaccaagugguacaguuucagaauggaaggugcacucuugaaggccagcuguuggguaccacacccgugucugcaaaccaagucgcucggauucgcgggaagguguucagcacuaauuccggaaccggccucaaccugacagagaccgauggcacgccauaucacgccuuugagucacccgcuccuuuaggguucccagacaucggagauugugacuggcauguuuacgccuucaaagugaaucagaacacuggugacccgauguaucgacuggauaucacacagggcaauaguuuugcaccccaccucgggagcauugaguucaccucugaccaacacccuuccggagaucagcuuggcacucugacauggauaucaccauugaacaaugccagcagagucgaccccuggaagaucccuaguuacgguucuacccuaacggaauccaccaaccuggcuccacccauuuuuccgccuggguucggcgaagcgaucguguauuuuaugagcgauuucccaauaguaucgggaaauacaacucagauucccugcacccucccucaggaguuuaucucuuccuucguugaacaacaggcacccaucaggggcgaggccgcucugcuucauuacguggacccagauacacaccggaaccugggggaguuuaaguuguacccugacggauucauuacuuguguccccaacaccgguggcgggccacagaaucucccgucaaacggaguguuuaucuucaguagcugggucucccguuauuaccagcugaaaccugugggcacagccggucccgcacgcagauuagggguuaggcggauuuga

SEQ ID NO: 19685 - RNA, 1647 nt, Artificial Sequence
  derived and/or modified sequence opt3 from major_capsid_protein__Norovirus__AFC89662
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaccgacaaucuuagugcugcccagaucacaaugugcccgcauguuauuguggauguccggcaacuggagcccgugaacuugccuaugccagacguacgcaauaacuucuuucacuauaaccaggggagcgauucccgacuccgucugaucgcgaugcuguacacuccccucagagccaauaacucuggagacgauguuuucaccgugucguguagggucuuaacacggccuucaccagacuuuagcuucaauuuucuggugcccccgaccguggaaaguaagacuaaaccuuucacacuucccauuuugaccaucuccgagaugucuaacagccgcuuuccagucccuauagauucccugcauacgucacccacugaaaauauuguugugcagugccagaacgguagaguaacccuagacggcgagcucauggggacaacucaacugcuuccaagucagaucugugcauucaggggagugcugacccggagcacaucucgcgcuuccgaucaggccgacaccgcuacgccccgauuguucaauuauuacuggcacauucagcucgacaaccugaauggcacuccuuaugauccagccgaggacaucccgggucccuuagggacaccugauuuuagaggaaagaucuucggcgucgcaucacaaaggaacccagacagcaccacucgggcccaugaagcuaaaguggauacaaccgcgggccguuuuacgcccaagcuggggagucucgagauuucuaccgaauccggagacuucgaucagaaucagccuacacgcuuuacuccaguugguauaggcguggacaacgaggcagauuuccaacaguggagccuucccgacuacucggggcaguuuacccacaauaugaaccuggccccggcugucgccccuaauuucccaggagaacaguugcuauuuuucagaucucaacugcccuccucaggcgguaggaguaacgggauccucgauugccuggugccucaggaguggguacagcacuuuuaccaggagagcgcacccgcccaaacacagguugcucuugugcgguaugucaacccagacacuggccgagugcuguucgaagccaaguugcauaaacucggauuuaugaccauugcaaagaauggcgacuccccuaucacagugcccccaaacggguacuuccgcuucgagucuugggucaauccguuuuauacccuggcgccuaugggaacugguaacggcagaaggcggauacaguga

SEQ ID NO: 19686 - RNA, 1620 nt, Artificial Sequence
  derived and/or modified sequence opt3 from major_capsid_protein__Norovirus__AFC89665
augaagauggccagcaacgacgcugcacccuccaaugauggcgccaccgggcuggugccugagaucaacacagaaacucucccacuugagccggucgcgggagcugccauugcagcccccguuacgggucagaauaacauaaucgacccuuggauuagaaauaacuucgugcaagcuccaaauggcgaauuuaccguaucucccaggaacucaccuggggagauccugaugaauuuggaauuaggaccagaucugaaccccuaccuagcacaccucagucggauguauaauggcuacgccggugggguggagguccaggugcugcuugcuggaaacgccuucacagcgggcaaaauucuguuugcagccguuccuccaaauuucccgguggacauguugagccccgcucagaucacuaugcucccucaucugauagucgaugugcgcacccuggagccaaucaugauuccccucccugacguacgaaacguguuuuaucacuucaauaaccagccagcaccccguaugagauuaguugccaugcuguacacaccgcuuagguccaacggcucuggggaugacgucuuuaccgugucgugccggguguugacucgcccuacacccgauuucgaauuuaccuaucuggucccaccuucaguugagagcaagacgaaacccuucacucuaccaauccucaccauuggagaacugacaaauaguagauuucccgcuccuaucgaccaacuuuacacuuccccaaacgccgaugugguagugcagccgcagaaugguagguguacccuggacggcgaguugcaggggacaacccaacuccugacgacugcgauaugcucuuaucggggaaugacaagcaaccccaccuccgauuacugggacgaccauuuacugcaccucguccauccuaauggcgccacuuacgauccaacagaggacgugcccgcaccuuucgguacccaggauuuucgcgggauucuuuauggaaugcugacgcagaacccacgaaccucaggcgacgaagcugccaauagucacggcaucuacauuagcucuacauccgagaaguucacucccaaauuggggaccaucggacuacaccagguucaaggugauaucgcuucaaaccagcagagcaaguucacaccggugggcauugccgucaaugggaacacuccuuuuagacaaugggaacugccaaauuauaguggagcacucacccugaacacaaaucuugcccccgcugugggcccuaacuuccccggugagcagauacuguuuuucaggucuaauguaccauccguucaagggggccagccuaucgaaauugacuguuugaucccccaggagugggugagccauuuuuaccaggagucggcgccaucucaguccgaugucgcacucgugcgguaugucaacccggacaccggacguacuauauucgaagccaagcugcaccgccagggcuuuauuacgaucgcugccacagggucaaacccugugguugugcccccaaauggauacuucagauuugauaguuggguaaaccaauucuaugcauuagcccccauggguaccggcaaugggaggcggcgaguccaguga

SEQ ID NO: 19687 - RNA, 1623 nt, Artificial Sequence; identical to SEQ ID NO: 18112
  derived and/or modified sequence opt3 from major_capsid_protein__Norovirus__AFC89667

SEQ ID NO: 19688 - RNA, 1626 nt, Artificial Sequence
  derived and/or modified sequence opt3 from major_capsid_protein__Norovirus__AFD62272
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguacuucagcccagacugugcacgcaugcaagguggccagcuccuguguacggcuugcucgucgaccccucccugccaucuaauccccaauggcagaacgggcgggugcacguugauggaacuuuacugggcaccacaccugugagcgguuccugggucucauguuucgccgcugaagccgcauaugaguuucagagugggacuggacaaguggccaccuucacaaugauugagcaggacggcagcgcuuacguaccaggcgaucgcgcggcaccgcucggguaccccgacuauucuggacagcuugaaaucgagguucagaccgaaacgacuaaggccggugacaaacugaaggugacaaccuuugagaugauuuugggcccuacuacaaaugucgaucaagcuccauaccaggggcgagccuaugcaucccuaaccgccgcugccucacuggaccucguggauggaagagucagggcagugccccggagcaucuacaguuuccaggacguucugccugaauauaacgauggccuucuggugccauuggcgcccccgcucgguccuuuccugccaggggagguauuacugcguuuucgcacguacaugagacagcuagacaccgcugaugccgcagcccaacccauagacugcgcucucccucaggaguucgucucuugguuugccuccaauagcuucacagugcagucggaugcacugcuuguuagguaucggaacacuuugaccggccagcugcucuuugaagcuaagcuguacucugagggauacauugccguguccuauucaggcagugggccccuuacauucccagcggacggauuuuucgaagucgugagcuggguaccucgacuguuucaauuggccuccguggguucucucgcuacuggccgcacccugaaacaguga

SEQ ID NO: 19689 - RNA, 1620 nt, Artificial Sequence
  derived and/or modified sequence opt3 from major_capsid_protein__Norovirus__AFJ04707
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugagcaauucccgcuuucccauaccacuggagaaacuuuacacgggacccucaagugcguucgugguucagccucagaacgguagauguacuaccgauggcguguugcuggggacaacucaacuaagcgccgucaauauuugcaccuucaggggagacaucacacauauugcaggcucucacgauuauaccaugaaccucgcuucccagaauuggucaaacuacgacccaacggaggaaaucccggcuccccuggguacuccugacuuuguggggaagauccagggaaugcuuacacagaccacucgggaggauggcagcacacgcgcccauaaggccaccguaaguacgggcucuguucacuucaccccaaagcugggguccgugcaauacacaacugacaccaauaacgauuuucagacaggacagaauacuaaauucacccccgucggugugauucaagacggcgggaaccaccagaaugaaccucagcagugggucuugccaaacuauagcggacgaacaggccauaaugugcaccucgcacccgccguugcuccgaccuuuccuggugagcaacuguuauucuuuagaucgacuaugccaggguguucuggcuaccccaacaugaaucuggauugccuccuuccucaggaaugggugcagcauuucuaucaggaggcggcacccgcccaauccgacguagcucuguugagguuugucaacccagauacgggacgggugcuauucgaguguaagcugcacaaaucaggcuacguuacaguggcccacaccgggccucaugaccucgucauacccccaaacggauauuuucguuucgauaguugggugaaucaguuuuacacucuggcaccgauggguaacggcgccgggcgcagaagggcucuuuga

SEQ ID NO: 19690 - RNA, 1623 nt, Artificial Sequence
  derived and/or modified sequence opt3 from major_capsid_protein__Norovirus__AFJ04708
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccaaguucacaccagucggagugguccaggauggcaacggugcucaccaaaaugagccccagcaguggguguugccgucuuacuccgggagaaccggccauaacguucaccucgccccugcaguggccccaacuuuucccggagaacagcuguuauucuuuaggucaacgaugccuggcuguagcggguaccccaacaugaaucuggacugccuccuuccacaagaguggguacagcauuucuaucaggaggcugcgccugcacagagugaugucgcccuguugcgguuugugaaccccgacacaggacguguucuauucgaauguaaacugcacaagucugguuacgugaccgucgcucacacuggccaacaugaucucgugauuccaccgaauggguauuuucgcuucgacuccuggguaaaccaguucuacacccuggccccuaugggaaauggcacagguagaaggcgggcacuuuga

SEQ ID NO: 19691 - RNA, 1623 nt, Artificial Sequence
  derived and/or modified sequence opt3 from major_capsid_protein__Norovirus__AFJ04709
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuaugucacaguggcccacaccgggcagcacgaucugguaauuccaccgaacggauacuuucgcuucgacuccugggugaaucaguucuauacucuugcaccuauggguaacggcaccgggggaagaagggcccuguga

SEQ ID NO: 19692 - RNA, 1623 nt, Artificial Sequence
  derived and/or modified sequence opt3 from major_capsid_protein__Norovirus__AFP89593
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacuccuacgccggcgguuucgaagugcaggucauucuagcggggaaugcauuuacugccggaaaaaucauuuucgcugccgugccuccaaacuuuccgacggagggccucucucccucgcagguaaccauguucccucauaucauaguugacgugcgccaacuggagccaguccuuaucccccugccugaugugcgaaauaacuuuuaucacuacaaucagucaaacgacccaacaauuaaguugaucgcaaugcucuauacuccccugcgugcuaacaaugccggcgaagauguguucaccgucagcugcagaguucugacaaggccgaguccugacuuugauuucauuuuucucgugcccccaaccguagagucccggacuaaaccuuucacagugcccaucuuaaccgucgaagagaugacgaacucucgcuuuccaauaccccuggagaaacuuuucacugggccuagcggagcguucgugguucagccacagaaugguagauguaccacagacggcguguugcuggggacuacccaacuauccccggucaacauuugcacauuuaggggagaugugacccauaucgccggcacgcacaauuacacuaugaaccucgcaucacagaauuggaacaauuaugaccccacagaagagauuccugcuccacuggguacccccgauuucguagggcggauccagggaaugcuuacucagacaacccgcggcgacggcaguacgcgagggcauaaggccaccguuagcacaggagacgugcacuuuacuccuaagcuggguucuauccaauucaacaccgauacaaauaacgacuuugaaacuggccagaauaccaaguucacaccagucggggugauucaggauggaaacggcacccaccaaaaugagccccagcagugggucuugccguccuacucagguagaacugggcauaacgugcaccucgcuccugccguugcaccaacguuucccggcgaacagcuguuauucuuuaggagcacaaugccuggauguaguggcuaccccaacaugaaucuggacugccuccuuccacaagagugggugcagcauuucuaucaggaggccgcuccugcgcagucugauguagcacuguugcgguuugucaaccccgacaccgggcgugugcuauucgaauguaaacugcacaaguccggauacguuacuguggcccacaccggucaacaugaucucgucauaccaccgaauggcuauuuucgcuucgacagcugggugaaccaguucuacacacuggcuccuauggggaauggaaccggcagaaggcggguacuuuga

SEQ ID NO: 19693 - RNA, 1623 nt, Artificial Sequence
  derived and/or modified sequence opt3 from major_capsid_protein__Norovirus__AFU55686
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaagcugggcagaauacuaaguucaccccagauggagucgugcaggacggcaacgguacacaccaaaaugagccccagcagugggucuugccgucuuacuccgggagaaccggccauaacgugcaccucgccccugcaauugccccaacuuuucccggagaacagcuguuauucuuuaggucaacgaugccuggcuguagcggguaccccaacaugaaucuggauugccuccuuccacaagaguggguucagcauuucuaucaggaggcugcgccugcacagagugacguggcccuguugcgguuuguaaaccccgauacaggacguguccuauucgaauguaaacugcacaagucugguuacgugaccguugcucacacuggccaacaugaccucgugauaccaccgaauggguauuuucgcuucgauuccugggucaaccaguucuacacccuggccccuaugggaaauggcacagguagaaggcgggcacuuuga

SEQ ID NO: 19694 - RNA, 1623 nt, Artificial Sequence
  derived and/or modified sequence opt3 from major_capsid_protein__Norovirus__AFU55689
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacugggugcccccgacuucguagggaagauccagggaguucuuacccaaacuacacggggcgacggcagcacccgcgggcacaaggcuacggugucuaccggauccguccauuuuacaccuaagcuggguucagugcaguucagcacugauaccaguaaugacuuggagacaggccagaacacucgauuuaccccagucggggugguucaagauggaucuacaacccaccagaaugaaccccagcagugggugcucccgaacuacuccggcagagacagccacaauguacaucuggccccugcagucgccccaacuuuccccggugagcaauuacuguuuuucaggucgacgaugccuggguguucuggcuaccccaacaugaaucucgauugccuucugccacaggaaugggugcagcacuuuuaucaggaguccgcuccugcgcaaucagacguugcauugcuacgguucgugaaccccgauacaggacguguccuguuugaguguaaacuccauaagaguggcuacgugaccguagcccacacugggcagcacgaccuggugaucccaccgaacggauauuuccgcuuugauagcuggguuaaucaguucuacacccuugcuccuauggguaacggcgccgggagaaggcgggcacuguga

SEQ ID NO: 19695 - RNA, 1623 nt, Artificial Sequence
  derived and/or modified sequence opt3 from major_capsid_protein__Norovirus__AFU55692
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccagauucacaccagucggcgugguucaagaugggucuaccacucaccagaaugaaccccagcaguggguguugccggacuacuccggaagggauagccacaacguacaucucgcuccugccgucgcaccaacguuucccggcgagcaacuguuauucuuucggucgacaaugccugguuguucuggguaccccaauaugaaccuggacugccuccuuccacaggaaugggugcagcacuucuaucaggaguccgccccugcucaaucagauguugcgcuguugcguuuugugaaucccgacaccggccgcguccuauucgaguguaaacugcauaagccaggauacgugacuguagcacacaccggccagcacgaucucgugaucccgccuaacggguauuuuagauucgacaguuggguuaaccaguucuacacacuggcccccaugggaaauggugcuggcaggcggcgagcccuuuga

SEQ ID NO: 19696 - RNA, 1623 nt, Artificial Sequence; identical to SEQ ID NO: 18125
  derived and/or modified sequence opt3 from major_capsid_protein__Norovirus__AFU55695

SEQ ID NO: 19697 - RNA, 1623 nt, Artificial Sequence
  derived and/or modified sequence opt3 from major_capsid_protein__Norovirus__AFU55698
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugggcgcuaacaacgccggggaugacguguucaccgucaguugccguguucugacaagaccguccccugauuuugacuucauuuuucucgugcccccaaccguagaaucuaggacuaaaccuuucagcgugcccaucuuaacagucgaggaaaugaccaauucccgguuuccaauaccccuggagaaacuuuucacgggaccuucaagugcguucgugguucagccacagaacggucgcuguacuaccgauggcguguugcuggggacaacucaacuaagcccggucaauauuugcaccuuuagaggagacgugacacauaucgccggcacccaggaguacacgaugaaccucgcaucucagaauuggaacaauuaugaucccacugaagagauuccugcuccacuggguacacccgacuucguagggaagauccagggaguucuuacccaaacuacaaggcgggacggcuccacccgcggccacaaggccacggugucaaccgggagcguccauuuuacaccuaagcugggacgaauccaguucaguacugauaccucuaacgacuuugaaacaggucagaauacuagauucaccccagugggcgucgugcaagauggguccacaacccaccagaacgagccccagcaguggguuuugccgaauuacagcggaagggacucgcacaacgugcaucucgcuccugccguagcaccaucuuuucccggcgaacaacuguuauucuuucgguccacuaugccugguuguucaggguaccccaauaugaaccuggauugccuccuuccacaggaguggguccagcacuucuaucaggaggccgcuccugcgcaaagugacguggcacuguugcguuuuguuaaucccgauacgggccgcgugcuauucgaauguaaacugcauaagagcggauacgucacaguggcccacaccggccagcacgaccucguaauuccaccgaacggguauuuuagauucgauuccugggugaaccaguucuacacucuggcuccuaugggaaaugguaccggcaggcggcgagcccuuuga

SEQ ID NO: 19698 - RNA, 1623 nt, Artificial Sequence; identical to SEQ ID NO: 18675
  derived and/or modified sequence opt3 from major_capsid_protein__Norovirus__AFU55701

SEQ ID NO: 19699 - RNA, 1623 nt, Artificial Sequence; identical to SEQ ID NO: 18764
  derived and/or modified sequence opt3 from major_capsid_protein__Norovirus__AFU55704

SEQ ID NO: 19700 - RNA, 1623 nt, Artificial Sequence
  derived and/or modified sequence opt3 from major_capsid_protein__Norovirus__AFU55707
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacugaaggcgacggcucuacacgcgggcacaaggcuaccguguacacgggauccgcccccuuuaccccuaaguuggguucaguccaguucagcacagacacugagaacgauuuugaaacccaucaaaauacaaaauucacuccagugggcgucauccaggacgggaguaccacacaccgaaacgagccccagcaaugggugcucccgucuuacuccggaagaaauguucacaacgugcaucuggccccugcaguagcuccaaccuuucccggcgagcaguuacuguucuuuaggagcacuaugccugguuguucgggguaucccaauauggaucucgacugccuucugccacaggaauggguccagcacuucuaccaagaggcggccccugcacagucugauguggcuuugcuacgguuuguuaaccccgacacgggccgugugcuguucgaauguaagcuccauaaauccggauaugucacaguggcccacaccggccagcacgaucugguaauuccaccgaacggguacuuucgcuucgacucaugggugaaucaguucuauacucuugcaccuaugggaaacgguaccggcagaaggcgggcccuguga

SEQ ID NO: 19701 - RNA, 1623 nt, Artificial Sequence; identical to SEQ ID NO: 18171
  derived and/or modified sequence opt3 from major_capsid_protein__Norovirus__AFU55710

SEQ ID NO: 19702 - RNA, 1623 nt, Artificial Sequence
  derived and/or modified sequence opt3 from major_capsid_protein__Norovirus__AFU55713
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucacgggcagucggaacuacacuaugaaucucgccacacagaacuggaauagcuaugaucccaccgaggaaauuccugcaccacuggguacucccgacuucguagggaagauccagggaguucuuacacagaccacgcgcgcugacggcucuacccgaggccacaaggccacaguguacacuggguccgcugauuuugccccuaagcugggaagaguccaauucgcaaccgacacagauaacgacuuugaugccaaucagaacacuaaauucaccccagugggugucauccaggacggcgauacagcucauaggaaugagccccaacaguggguguugccgucauacagcgggcggaacagucacaauguucaccucgcgccugcaguggccccaaccuuucccggagaacagcuguuauucuuucguucuacuaugccuggcuguuccgguuaucccaacauggaccuggauugccuccuuccacaggaguggguacaauacuucuaucaggaagcugccccugcacagagcgacgucgcccuguugcgcuuugugaaucccgauacggggagaguucuauucgaguguaagcugcauaaaucgggcuacgugacagucgcucacaccggacagcaugaccucgugauuccaccgaacggcuauuuuagguucgacucuuggguaaaccaauucuacacucuggccccuauggggaauggaaccggucggcgacgcgcacuuuga

SEQ ID NO: 19703 - RNA, 1623 nt, Artificial Sequence
  derived and/or modified sequence opt3 from major_capsid_protein__Norovirus__AFU55716
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguucagaacgugcaccuggccccugcaguagcuccaaccuuucccggugagcaguuacuguucuuuagguccacuaugccuggguguagcggcuaucccaauauggaucucgacugccuucugccacaggaguggguccaacauuucuaccaggaagcggccccugcacagucggauguggcuuugcuacgguuuguuaaccccgacacgggacgugugcuguucgaguguaaacuccacaagucuggcuaugucacaguggcccauaccgggcagcacgaucugauuauaccaccgaacggauacuuucgcuucgacuccuggguaaaucaauucuauacucuugcaccuauggguaacggcaccgggagaaggcgggcccuguga

SEQ ID NO: 19704 - RNA, 1623 nt, Artificial Sequence; identical to SEQ ID NO: 18747
  derived and/or modified sequence opt3 from major_capsid_protein__Norovirus__AFU55719

SEQ ID NO: 19705 - RNA, 1623 nt, Artificial Sequence; identical to SEQ ID NO: 17662
  derived and/or modified sequence opt3 from major_capsid_protein__Norovirus__AFU55722

SEQ ID NO: 19706 - RNA, 1623 nt, Artificial Sequence
  derived and/or modified sequence opt3 from major_capsid_protein__Norovirus__AFU55725
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucucugcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacgggaccuucaaguacuuucgugguucagccacagaacgguagauguaccacagauggcguguugcuggggacuacccaacuaagcccggucaauauuugcacauuuaggggagacgugacccauaucacgggcucucggaacuacacuaugaaucucgccucccagaacuggaacucauaugaucccacagaggaaauuccugcgccacuggguacccccgacuucguagggaagauccagggaguucuuacucagacaacccgcacggacggcagcacccgaggccacaaggccacaguguacacugggagugcagaguuuucuccuaagcugggaagaguccaauucgcuaccgauacagacaaugauuuugacgccaaucagaacacuaaauucaccccagugggugucauccaggauggcgggacaacccauaggaaugaaccccaacaguggguguugccguccuacagcggacggaacacucacaauguucaccucgcuccugccguggcaccaacguuucccggcgagcagcuguuauucuuucguucgacaaugccugguuguucuggguaucccaacauggaccuggauugccuccuuccacaggaauggguacaacauuucuaccaggaggccgcuccugcgcaguccgacgucgcacuguugcgcuuugugaaucccgauaccggcagaguucuauucgaguguaagcugcacaaaucaggauaugugacugucgcccauaccggccagcacgaccucgugauuccaccgaacggguacuuuagguucgauaguuggguaaaccaauucuauacacuggcuccuaugggaaaugguaccggccggcgacgcgcccuuuga

SEQ ID NO: 19707 - RNA, 1623 nt, Artificial Sequence
  derived and/or modified sequence opt3 from major_capsid_protein__Norovirus__AFU55728
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccacaacuacaccaugaaucucgccucucagaacuggaacuccuaugauccuacggaggaaaucccagcaccccuggguacuccugacuucguugggaagauucagggagugcuuacacagaccacucggacaaauggcucaacccgcggccauaaggcuacggucuacaccgggagcgccgacuuuaguccaaagcugggacgagugcaauucgcuacagauacuaauaacgacuuugagaccaaucagaacacaaaauucacucccgucggugugauccaggauggcucuaccacaccgagaaaugaaccucaacaguggguuuugccauccuacagcgggaggaacacccacaaugugcaccucgcccccgcaguagccccuacuuuucccggagagcagcuguuauucuuucggucgacgaugccaggcuguucugguuauccuaacauggaccuggauugccuccuuccccaggaauggguccaauacuucuaucaggaggcugcgccagcacaguccgacguggcccuguugcguuuuguuaacccggauacagggcgcgugcuauucgaguguaagcugcauaaaucaggcuacgucaccguggcucacacuggacagcaugaccucguaaucccucccaauggcuauuuuagauucgauaguugggugaaccaauucuacacccuggccccaauggggaauggaacagguaggcggcgagcacuuuga

SEQ ID NO: 19708 - RNA, 1623 nt, Artificial Sequence
  derived and/or modified sequence opt3 from major_capsid_protein__Norovirus__AFU55731
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccacaacuacaccaugaaucucgccucucagaacuggaacuccuaugauccuacggaggaaguuccagcaccccuggguacuccugacuucguggggaagauccagggaguccuuacacagaccacucggacaaauggcucaacccgcggccauaaggcuacgguguacaccgggagcgccgacuuuaguccaaagcugggacgaguccaauucgcuacagauacuaauaacgacuuugagaccaaucagaacacaaaauucacucccguggguguuauucaggauggcucuaccacaccgagaaaugaaccucaacaguggguguugccauccuacagcgggaggaacacccacaauguacaccucgcccccgcagucgccccuacuuuucccggagagcagcuguuauucuuucggucgacgaugccaggcuguucugguuauccuaacauggaccuggauugccuccuuccccaggaaugggugcaauacuucuaucaggaggcugcgccagcacaguccgacguugcccuguugcguuuugugaacccggauacagggcgcguccuauucgaguguaagcugcauaaaucaggcuacgugaccguagcucacacuggacagcaugaccucgugaucccucccaauggcuauuuuagauucgauaguuggguuaaccaauucuacacccuggccccaauggggaauggaacagguaggcggcgagcacuuuga

SEQ ID NO: 19709 - RNA, 1623 nt, Artificial Sequence; identical to SEQ ID NO: 17702
  derived and/or modified sequence opt3 from major_capsid_protein__Norovirus__AFU55734

SEQ ID NO: 19710 - RNA, 1623 nt, Artificial Sequence; identical to SEQ ID NO: 17702
  derived and/or modified sequence opt3 from major_capsid_protein__Norovirus__AFU55737

SEQ ID NO: 19711 - RNA, 1623 nt, Artificial Sequence
  derived and/or modified sequence opt3 from major_capsid_protein__Norovirus__AFU92659
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacucaacuauuaaguugaucccaaugcucuauaccccucugcgugcaaacaacgcuggggaugacguguucacagucagcugcagaguucugaccaggccgaguccugauuuugacuucauuuuucucgugcccccaacuguagaaucccggacaaaaccuuucucugugcccaucuuaaccgucgaggaaaugacgaauagccgcuuuccaauaccccuggagaaacuuuucacuggaccuuccucagccuucgugguucagccacagaacgguagauguaccacagauggcguguugcuggggacuacccaacuaaguccggucaauauuugcacauuuaggggagacgugacccauaucgcgggcacgcagagcuacacuaugaaccucgccucucagaauuggaacaauuaugaucccacagaggaaauuccugcaccacuggguacccccgacuucguagggaagauccagggaguucuuacucaaacaacccggggcgacggcuccacgcgcgggcacaaggcuaccgugucaacaggaagcguccauuuuacuccuaagcuggguagugugcaguucucuaccgauacauccaacgacuuugagacuggccagaauacccgauucacaccagucggggugguucaagauggaagcaccacucaccagaacgaaccccagcaguggguguugccgaauuacucgggcagagacucucacaacguacaucucgccccugcugucgccccaacguuucccggugagcaacuguuauucuuuagguccacaaugccuggguguucaggcuaccccaauaugaaccuggauugccuccuuccacaggaaugggugcagcacuucuaucaggagagugcacccgcccaaagcgacguugcucuguugcgguuugugaaucccgauaccggacguguccuauucgaguguaaacugcauaaguccggcuacgugacuguagcgcacaccgggcagcacgaccucgugaucccaccgaacggauauuuucgcuucgauucuuggguuaaccaguucuacacacuggcaccuauggguaauggcgccgggagaaggcgggcucuuuga

SEQ ID NO: 19712 - RNA, 1623 nt, Artificial Sequence
  derived and/or modified sequence opt3 from major_capsid_protein__Norovirus__AFU92660
augaagauggccagcaacgacgcucaccccuccgauggcucuaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuucaccaaggaaugcacccggggagauccuuuggagugccccucugggaccagauuugaaccccuacuuaagccaucuggcucggauguauaauggcuacgccgguggguucgaagugcagacuauucuagcgggaaacgcauuuacggccggcaaaaucauuuucgcugccgucccuccaaauuuuccgaccgagggccucucccccucucaggugacaauguucccucacaucauaguagacguucgccaacuggagccagugcuuaucccccugccugauguccgaaacaauuuuuaucauuacaaccagucgaaugacccaacuauuaaguugaucgcaaugcucuauacaccccugcgugcuaacaacgccggggaugacguguucaccgugucaugcagaguccugaccaggccgagcccugauuuugacuucauuuuucucguucccccaacuguggaaagucggacaaaaccuuucaccguacccaucuuaacgguggaggaaaugacuaauucccgcuuuccaauaccccuggagaaacuuuucaccggaccuucuagcgcguucgucgugcagccacagaacgguagauguacaacugauggcguuuugcuggggaccacacaacuauccccggugaauauuugcaccuuuaggggagacgucacgcacaucgccggcacucauaacuacacaaugaaucucgcaucacagaacuggaauaacuaugaucccaccgaggaaauuccugcuccacuggguacucccgacuucguggggcggauccagggaaugcuuacacagaccacgcgcggcgacggcaguacccgagggcacaaggccacaguaagcacuggagauguucacuuuaccccuaagcuggguucuauccaauucaauacagacacuaacaaugauuuugagaccggccagaacacaaaguucaccccagugggggucgugcaggacggaaauggcacucaucaaaacgaaccccagcagugggucuugccguccuacucagguagaacggggcacaaugugcaucucgcuccugccguugcaccaacauuucccggcgagcagcuguuauucuuuaggagcaccaugccuggauguaguggcuaccccaacaugaaccuggauugccuccuuccacaagaaugggugcagcacuucuaucaggaggccgcuccugcgcagucugacguagcacuguugcgguuugucaaucccgauacugggcgugugcuauucgaguguaaacugcacaaguccggauacguuaccguggcccauacaggucaacacgaccucgucauuccaccgaacggcuauuuucgcuucgauagcugggugaaucaguucuacacccuggcuccuauggggaacggaacuggcagaaggcgggcccuuuga

SEQ ID NO: 19713 - RNA, 1623 nt, Artificial Sequence
  derived and/or modified sequence opt3 from major_capsid_protein__Norovirus__AFU92661
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuugccacgccccucugggaccagauuugaaccccuacuuaagucaucuggcucggauguauaauggcuacgccgguggguucgaagugcaggucauucuagcgggaaacgcauuuacggccggcaaaaucauuuucgcugccgugccuccaaauuuuccgaccgagggccucagccccucccagguaacaauguucccucacaucauaguugacgugcgccaacuggagccaguccuuaucccccugccugaugugcgaaacaauuuuuaucauuacaaccagucuaaugacccaacuauuaaguugaucgcaaugcucuauacgccccugcgugcuaacaacgccggggaugacguguucacagucucguguagaguucugaccaggccgucaccugauuuugacuucauuuuucucgugcccccaacuguagaaagccggacaaaaccuuucagugugcccaucuuaaccgucgaggaaaugaccaauucccgcuuuccaauaccccuggagaaacuuuucacuggaccuucuagcgcguucgugguucagccacagaacgguagaugcaccacagauggcguguugcuggggacuacccaacuauccccggucaauauuuguacauuuaggggagacgugacccacaucgccggcacgcagaacuacacuaugaaucucgcaucacagaacuggaauaacuaugaucccacagaggaaauuccugcuccacuggguacccccgacuucguagggcggauccagggaguucuuacucaaacaacccgccgagacggcaguacgagaggccauaaggccacccugagcacagggucugugcacuuuacuccuaaguugggauccguccaguucucaaccgauacaagcaaugacuuugagacuggucagaacaccagguucacaccagugggcgucgugcaagaugggaguaccacucaccagaaugaaccccagcaguggguucucccgaacuacucuggacgggacucccauaaugugcaccuggcuccugccguagcaccaacguuucccggcgagcaauuacuguucuuucguagcacaaugccugguugcucgggguaccccaacaugaaucucgauugucuucugccacaggaauggguccagcauuucuaucaggagucugccccugcucaauccgacguggcguugcuacgcuuuguuaaccccgauaccggcagagugcuguucgagugcaagcuccacaaaucaggauacgucacuguggcacacaccggccagcaugaccugguaaucccaccgaacggguauuuuagguucgauaguugggugaaucaguucuacacacuugccccuaugggaaacggugcuggccggcgacgcgcccuguga

SEQ ID NO: 19714 - RNA, 1623 nt, Artificial Sequence
  derived and/or modified sequence opt3 from major_capsid_protein__Norovirus__AFU92662
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggcacgccccucugggaccagauuugaaccccuacuuaagucaucuggcucggauguauaauggcuacgccgguggguucgaagugcaggucauucuagcgggaaacgcauuuacggccggcaaaaucauuuucgcugccgugccuccaaauuuuccgaccgagggccucagccccucccagguaacaauguucccucacaucauaguugacgugcgccaacuggagccaguccuuaucccccugccugaugugcgaaacaauuuuuaucauuacaaccagucuaaugacccaacuauuaaguugaucgcaaugcucuauacgccccugcgugcuaacaacgccggggaugacguguucacagucucgugcagaguucugaccaggccgucaccugauuuugacuucauuuuucucgugcccccaacuguagaaagccggacaaaaccuuucagugugcccaucuuaaccgucgaggaaaugaccaauucccgcuuuccaauaccccuggagaaacuuuucacuggaccuucuagcgcguucgugguucagccacagaacgguagauguaccacagauggcguguugcuggggacuacccaacuauccccggucaauauuugcacauuuaggggagacgugacccacaucgccggcacgcagaacuacacuaugaaucucgcaucacagaacuggaauaacuaugaucccacagaggaaauuccugcuccacuggguacccccgacuucguagggaagauccagggaguucuuacucaaacaacccggcgcgacggcaguacgcgaggccauaaggccaccgugagcacagggucuauccacuuuacuccuaagcugggauccguccaguucucaaccgauacaagcaaugacuuugagacuggucagaacaccagauucacaccagugggcgucgugcaagaugggaguaccacucaccagaaugaaccccagcaguggguuuugccgaacuacucuggaagggacucccauaaugugcaccucgcuccugccguagcaccaacguuucccggcgagcaacuguuauucuuucggagcacaaugccugguuguucgggguaccccaacaugaaucuggauugccuccuuccacaggaauggguccagcauuucuaucaggagucugccccugcucaauccgacguggcgcuguugcguuuuguuaaccccgauaccggccgcgugcuauucgaguguaaacugcacaagucaggauacgucacuguggcacacaccggccagcaugaccucguaauuccaccgaacggguauuuuagauucgauaguugggugaaucaguucuacacacuggccccuaugggaaacggugcuggcaggcggcgagcccuuuga

SEQ ID NO: 19715 - RNA, 1623 nt, Artificial Sequence
  derived and/or modified sequence opt3 from major_capsid_protein__Norovirus__AFU92663
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccugucccggauguauaauggcuacgcugguggguucgaagugcaggucauucuagccggaaacgcguuuacggcaggcaaaaucauuuucgccgcugugccuccaaauuuuccgaccgagggccucucucccucgcagguaacaauguucccucauaucauaguugacgugcgccaacuggagccaguccuuaucccccugccugaugugcgaaacaauuuuuaucacuacaaccagucaaaugacccaacuauuaaguugaucgccaugcucuauacaccccugcgugcaaacaacgcuggggaugacguguucaccgucagcugcagaguucugaccaggccgaguccugauuuugacuucauuuuucucgugcccccaacuguagaaucccggacaaaaccuuucucugugcccaucuuaaccgucgaggaaaugacgaauagccgcuuuccaauaccccuggagaaacuuuucacuggaccuuccucagccuucgugguucagccacagaacgguagauguaccacagauggcguguugcuggggacuacccaacuaaguccggucaauauuugcacauuuaggggaaacgugaccaauaucgcgggcagccagacguacacuaugaaccucgccucucagaauuggaacaauuaugaccccacagaggaaauuccugcaccacuggguacccccgauuucguagggcggauccagggaguucuuacucaaacaacccgcggcgacggcuccacgcgagggcauaaggcuaccgugucaacaggaagcgccuacuuuacuccuaagcuggguaguguccaguucucuaccgacacauccacugauuuugagaccggccagaacacaagauucaccccagugggggucgugcaagacggaagcacuacgcacaagaaugaaccccagcaguggguuuugccgucguacucuggcagggauucccauaacgugcaccucgcuccugccguagcaccaacauuucccggugagcagauccuguucuuucggucaaccaugccuggguguaguggcuaucccaauauggacuuagauugccugcucccacaagaauggguccagcacuucuaccaggagagcgccccugcucaguccgacguggcgcuucugcguuuuguuaaccccgauacuggacgcguguuguucgaguguaaacuacauaagucuggcuaugucaccguggcacacacagggcaacaugaccugguaauuccaccgaauggauacuuuagauucgauagcugggugaaccaguucuauacccucgccccuauggguaacggcgcugggaggcggcgagcccuguga

SEQ ID NO: 19716 - RNA, 1623 nt, Artificial Sequence
  derived and/or modified sequence opt3 from major_capsid_protein__Norovirus__AFU92664
augaagauggccagcaacgacgcuaaucccuccgauggcucugcagcccaccuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuucaccaaggaaugcccccggggagauccuuuggagugcuccucugggaccagauuugaaccccuacuuaagccaucuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucacaucauaguugacgugcgccaacuggagccaguccuuaucccccugccugaugugcgaaacaauuuuuaucauuacaaccagucgaaugacucaaccauuaaguugaucgcuaugcucuauacaccacugcgugccaacaacgcgggggaagauguguucacugucagcugcagaguucugaccaggcccaguccggacuuugauuucauuuuucucgugccucccacaguagagucccggaccaaaccauucacugugccuaucuuaacagucgaagagaugaccaauucucgcuuucccauaccacuggagaaacuuuucacgggacccagcggugccuucgugguucagccucagaacggcagauguacuaccgacgggguguugcugggaacaacucaacuauccccagucaauauuugcaccuuuaggggcgaugugacacacaucgcagguucacggaacuacaccaugaaucucgcuagucugaacuggaauaacuaugacccgacggaagagauucccgccccucuugggacuccagauuucguaggaaagauccagggcguucugacacagaccacuaagggcgacgggagcacacgcggacauaaggcuaccguguacacggguucugcccccuuuaccccuaaauugggcuccguccaguucucaacagacacugaaaaugauuuugagacccaccaaaacacaaaguucacuccagugggggucauccaggacggaagcaccacacaccgaaaugaaccccagcaaugggugcucccgaguuacucuggcagaaacguucauaaugugcaccuggccccugcaguagcuccaaccuuucccggugagcaguuacuguucuuuagguccacuaugccuggguguagcggcuaucccaacauggaucucgacugccuucugccacaggaguggguccagcauuucuaccaagaagcggccccugcacagucggauguggcuuugcuacgguuuguuaaucccgacacgggacgugugcuguucgaguguaaacuccacaagucuggcuaugucacaguggcccacaccgggcagcaugaucugguaauuccaccgaacggauacuuucgcuucgacuccugggugaaccaguucuauacucuugcaccuauggguaauggcaccgggagaaggcgggcccuguga

SEQ ID NO: 19717 - RNA, 1623 nt, Artificial Sequence
  derived and/or modified sequence opt3 from major_capsid_protein__Norovirus__AFU92666
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccagucucgacuuugauuucaucuuuuuagugccgccuacaguagagucccggaccaaacccuucacugugccaauccugacagucgaagagaugaccaacucucgcuuuccuauaccccuugagaaguuguucacgggaccaagcggugccuucgugguucagccccagaauggcagauguacuaccgacggggugcugcuaggaacaacucaacucuccccugucaacauuugcaccuuuaggggcgaugugacacauaucgcagguucacggaauuacaccaugaaccuggcuagucuuaauuggaacaauuaugacccaacggaagagacuccggcuccccuggggacaccugauuucguaggaaaaauucagggcguuuugacccagacuacaaagggcgacgggagcacccgcggacacaaggccacgguguacaccgguucugccccauuuacacccaaacucggcuccguccaguucucaacugacaccgaaaacgauuuugagacacaucaaaauacuaaguucaccccugugggggucauccaggacggaggcacaacccaccgaaacgaaccacagcaaugggugcugcccagcuacagugguagaaauguucacaacgugcauuuagcaccggccguagcuccuacuuuuccaggggagcagcuccucuucuuuaggucuacgaugcccggcuguuccggauauccuaauauggaucuugacugccuguugccccaggaguggguccagcacuucuaccaagaagcggcaccagcccagagcgauguggcucuacugcgguuuguuaacccugacacaggccgugugcuguucgaguguaaacugcauaagucgggguaugucaccguggcccacacuggacagcacgaucuuguaauucccccaaacgguuacuuucgcuucgacucuugggugaaucaguucuauacccuggcaccgaugggcaacgggacaggaagaaggcgggccuuguga

SEQ ID NO: 19718 - RNA, 1623 nt, Artificial Sequence
  derived and/or modified sequence opt3 from major_capsid_protein__Norovirus__AFU92667
augaagauggccagcaacgacgcuacccccuccgauggcguggcagcccaccuggucccugagguuaauaacgaagugauggcgcucgagccaguagugggggcugccaucgcagccccggucgcuggacagcaaaaugugauugaccccuggauaagaaacaauuucguucaggcaccugguggcgaauuuacagugucuccaaggaacgcccccggggagauccuuuggucagcuccucugggaccagauuugaaucccuacuuaagucaucuggcccggauguauaacggcuacgcggguggguucgaaguccaggugauucuagcaggaaaugccuuuacugcuggcaaaaucauuuucgccgcaguaccuccaaacuuuccgacggagggccucagccccucccagguuaccauguucccucacaucauaguggacguccgccaacuggagccagugcuuaucccccugccugaugugcgaaauaacuuuuaucauuacaaucagucuaacgacucgacaauuaaguugaucgcuaugcucuauacuccacugcgugccaauaacgcgggggaagaugucuucaccguuucaugcagagugcugacaaggcccagcccggacuuugauuucauuuuucucguaccucccaccguggagagucggacuaaaccauucacagucccuaucuuaaccguggaagagaugacgaacucccgcuuucccauaccacuggagaaacuuuucacuggacccucuggugccuucguugugcagccucagaauggcagauguaccacagacggggucuugcugggaacuacccaacuaagcccagugaacauuugcacauuuaggggcgauguaacccacaucgcagguucccggaauuacacgaugaaccucgcuucacugaauuggaacaauuaugacccgacugaagagauucccgccccucuugggacaccagauuucguuggaaagauccagggcgugcugacccagacuacaaagggcgacgggaguacccgcggacauaaggcuacggucuacaccgguagcgcccccuuuacaccuaaauugggcucugugcaguucuccacugacaccgaaaacgauuuugagacacaccaaaauacuaaguucaccccagucggggugauccaggacggaggcacaacccaccgaaacgaaccccagcaauggguucucccgucauacagcgguagaaaugugcauaacguacaccuggccccugcagucgcuccaacuuuucccggggagcaguuacuguucuuuaggaguacgaugccuggcuguucuggauaucccaauauggaucucgacugccuucugccacaggagugggugcagcauuucuaccaagaagcggccccugcacaguccgauguugcuuugcuacgguuugugaaccccgacacaggccguguccuguucgaguguaaacuccacaagagcggguaugugaccguagcccacacuggacagcaugaucuggugauuccaccgaaugguuacuuucgcuucgacucguggguuaaccaguucuauacccuugcaccuaugggcaacgggacaggaagaaggcgggcccuguga

SEQ ID NO: 19719 - RNA, 1623 nt, Artificial Sequence
  derived and/or modified sequence opt3 from major_capsid_protein__Norovirus__AFU92668
augaagauggccagcaacgacgugacccccuccgauggcucugcugcaaaucuggucccugagguuaacaaugaagugauggcccucgagccaguagugggggcggcuaucgccgcaccggucgccggacagcaaaacgugauugaccccuggauaagaaauaacuucguucaggcuccugguggcgaauuuacagugucaccaaggaaugcacccggggagauccuuuggagugccccucugggaccagauuugaaccccuacuuaagccaccuggcucggauguauaauggcuacgccgguggguucgaaguccaggugauucuagcgggaaacgcauuuacugccggcaaaaucauuuucgcugccguaccuccaaauuuuccgacggagggccucucccccucucagguuaccauguucccucauaucauaguggacguccgccaacuggagccagugcuuaucccccugccugaugugcgaaacaauuuuuaucacuacaaccagucgaaugacucaacaauuaaguugaucgcaaugcucuauacuccacugcgugcuaacaacgccggggaagaugucuucaccguuagcugcagagugcugacaaggcccaguccggacuuugauuucauuuuucucguaccucccaccguggagucccggacuaaaccauucacagucccuaucuuaaccguggaagagaugacuaauucucgcuuucccauaccacuggagaaacuuuucacgggacccagcggugcguucguugugcagccucagaacggcagauguaccacagacggggucuugcugggaacuacccaacuauccccagugaauauuugcacauuuaggggcgauguaacccauaucgccgguucacggaacuacacgaugaaucucgcaagucugaacuggaauaacuaugacccgacugaagagauucccgcuccucuugggacaccagauuucguuggaaagauccagggcgugcugacccagacuacaaagggcgacgggagcacccgcggacacaaggccacggucuacaccgguucugcucccuuuacaccuaaauugggcuccgugcaguucucaacugacaccgaaaaugauuuugagacacaucaaaacacuaaguucaccccagucggggugauccaggacggaggcacaacccaccgaaaugaaccccagcaauggguucucccgagcuacagugguagaaacgugcacaauguacaucuggccccugcagucgccccaacuuuucccggggagcaguuacuguucuuuaggucuacgaugccuggcuguuccggauaucccaacauggaucucgacugccuucugccacaggagugggugcagcacuucuaccaagaagcugcgccugcacagagcgauguugccuugcuacgguuugugaaucccgacacaggccguguccuguucgaguguaaacuccauaagucgggguaugugaccguagcucacacuggacagcacgaucuggugauuccaccgaacgguuacuuucgcuucgacucuuggguuaaccaguucuauacccuugccccuaugggcaaugggacaggaagaaggcgggcacuguga

SEQ ID NO: 19720 - RNA, 1623 nt, Artificial Sequence; identical to SEQ ID NO: 18730
  derived and/or modified sequence opt3 from major_capsid_protein__Norovirus__AFU92669

SEQ ID NO: 19721 - RNA, 1623 nt, Artificial Sequence
  derived and/or modified sequence opt3 from major_capsid_protein__Norovirus__AFU92670
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggcgggcuccucugggaccagauuugaaucccuacuuaagucaccuggcccgcauguauaacggcuacgcggguggguucgaagugcaggucauucuagcaggaaaugccuuuacagcuggcaaaaucauuuucgccgcagugccuccaaacuuuccgacugagggccucagccccucccagguaacgauguucccucauaucauaguugacgugcgacaacuggagccaguccuuaucccccugccugaugugcguaauaacuuuuaucacuacaaucagucuaacgacucgaccauuaaguugaucgcuaugcucuauacaccacugagagccaacaaugcgggggaagauguguucacugucucaugcaggguucugacccggcccagcccggacuuugauuucauuuuucucgugccucccacaguagagagucgcaccaaaccauucacugugccuaucuuaacagucgaagagaugaccaacuccagauuucccauaccacuggagaaacuuuucacgggacccucuagcgccuucgugguucagccucagaaugguagguguacuaccgacggcguguugcuggggacaacucaacuauccccagucaacauuugcaccuuucggggagaugugacacauaucgcaggcucacgcaauuacaccaugaaccucgcuagucugaauuggaacaauuaugacccgacggaagagguacccgccccucuugguacuccagauuucguugggaagauucagggagugcugacacagaccacuaagggcgacggcagcacacgagggcacaaggcuaccgucuacacgggaucugcccccuuuaccccuaaauuggguuccgugcaguucucaacagacacugaaaacgauuuugagacccaucaaaauacaaaguucacuccagucggcgugauccaggacgggagcaccacacacagaaacgaaccccagcaauggguucucccgaguuacucuggaaggaaugugcacaacguacaucuggccccugcagucgcuccaaccuuucccggcgagcaguuacuguucuuucgguccacuaugccugguuguagcggguaucccaauauggaucucgacugccuucugccacaggagugggugcagcacuucuaccaagaagcggccccugcacagucggauguugcuuugcuacguuuugugaaccccgacacgggccgcguccuguucgaguguaaacuccauaagucuggauaugugacaguagcccacaccggccagcacgaucuggugaucccaccgaacggguacuuuagauucgacuccuggguuaaucaguucuauacucuugcaccuaugggaaacgguaccggcaggcggcgagcccuguga

SEQ ID NO: 19722 - RNA, 1623 nt, Artificial Sequence
  derived and/or modified sequence opt3 from major_capsid_protein__Norovirus__AFU92671
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguccggucaauauuugcaccuuucggggagacgugacacauaucgccggcacccaggaguacacgaugaaccucgcaagccagaauuggaacaauuaugaucccacugaagagauuccugcuccacuggguacacccgacuucguagggaagauccagggaguucuuacccaaacuacacgccgagacggcucuaccagaggccacaaagccacgguguccaccgggucaguccauuuuacaccuaagcugggaaggauccaguucagcacugauaccaguaacgacuuugaaacaggucagaauacucgguucaccccagugggcgucgugcaagaugggucuacaacccaccagaacgagccccagcaguggguuuugccggacuacuccggacgugauagccacaaugugcaucucgcuccugccguagcaccaucguuucccggcgaacaacuguuauucuuucgcucuacuaugccugguuguuccggguaccccaacaugaaucuggacugccuccuuccacaggaguggguccagcacuucuaucaggaggccgcuccugcgcaaucagauguggcacuguugagauuuguuaaccccgacacgggcagggugcuauucgaauguaagcugcauaaaaguggauacgucacaguggcccacaccggccagcacgaucucguaauuccaccgaauggguauuuucgguucgacagcugggugaaccaguucuacacucuggcuccuaugggaaacgguaccggccgacgcagagcccuuuga

SEQ ID NO: 19723 - RNA, 1623 nt, Artificial Sequence
  derived and/or modified sequence opt3 from major_capsid_protein__Norovirus__AFU92672
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagacucccgccccucuugggacaccagauuucguaggaaagauucagggcguucugacccagacuacaaagggcgacgggagcacccgcggacacaaggcuacgguguacaccgguucugcccccuuuacaccuaaauugggcuccguccaguucucaacugacaccgaaaacgauuuugagacacaucaaaauacuaaguucaccccagugggggucauccaggacggaggcacaacccaccgaaacgaaccccagcaaugggugcucccgagcuacagugguagaaauguucacaacgugcaucuggccccugcaguagcuccaacuuuucccggggagcaguuacuguucuuuaggucuacgaugccuggcuguuccggauaucccaauauggaucucgacugccuucugccacaggaguggguccagcacuucuaccaagaagcggccccugcacagagcgauguggcuuugcuacgguuuguuaaccccgacacaggccgugugcuguucgaguguaaacuccauaagucgggguaugucaccguggcccacacuggacagcacgaucugguaaucccaccgaacgguuacuuucgcuucgacucuugggugaaucaguucuauacccuugcaccuaugggcaacgggacaggaagaaggcgggcccuguga

SEQ ID NO: 19724 - RNA, 1623 nt, Artificial Sequence
  derived and/or modified sequence opt3 from major_capsid_protein__Norovirus__AFU92673
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgcagugcagccucagaauggcagauguacuaccgacgggguuuugcugggaacaacucaacuauccccagugaacauuugcaccuuuaggggcgaugucacacauaucgcugguucacggaauuacaccaugaaccucgccagucugaauuggaacaauuaugacccgacggaagagauucccgcuccucuugggacuccagauuucgugggaaagauccagggcguacugacacagaccacuaagggcgacgggagcacacgcggacacaaggccaccguuuacacggguucugcacccuuuaccccuaaauugggcuccgugcaguucucaacagacacugaaaacgauuuugagacccaucaaaauacaaaguucacuccagucggggugauccaggacggaggcaccacacaccgaaacgaaccccagcaauggguccucccgagcuacagugguagaaaugugcacaacguucaucuggccccugcuguggcgccaaccuuucccggggagcaguuacuguucuuuaggucuacuaugccuggcuguuccggauaucccaauauggaucucgacugccuucugccacaggaguggguacagcacuucuaccaagaagcagccccugcucagagcgaugucgccuugcuacgguuugugaaccccgacacgggccguguucuguucgaguguaaacuccauaagucgggguaugcaacaguggcccacaccggacagcacgaucuggucauuccaccgaacgguuacuuucgcuucgacucuugggugaaucaguucuauacucuugcuccuaugggcaacgggaccggaagaaggcgggcccuguga

SEQ ID NO: 19725 - RNA, 1623 nt, Artificial Sequence
  derived and/or modified sequence opt3 from major_capsid_protein__Norovirus__AFU92674
augaagauggccagcaacgacgcucaccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuucaccaaggaaugcccccggggagauccuuuggagugcuccucugggaccagauuugaaccccuacuuaagccaucuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucacaucauaguugacgugcgccaacuggagccaguccuuaucccccugccugaugugcgaaacaauuuuuaucauuacaaccagucgaaugacucaaccauuaaguugaucgcuaugcucuauacaccacugcgugccaacaacgcgggggaagauguguucacugucagcugcagaguucugaccaggcccaguccggacuuugauuucauuuuucucgugccucccacaguagagucccggaccaaaccauucacugugccuaucuuaacagucgaagagaugaccaauucucgcuuucccauaccacuggagaaacuuuucacgggacccagcggugccuucgugguucagccucagaacggcagauguacuaccgacgggguguugcugggaacaacucaacuauccccagucaauauuugcaccuuuaggggcgaugugacacacaucgcagguucacggaacuacaccaugaaucucgcuagucugaacuggacgaauuaugacccgacugaagagauucccgccccucuugggacaccagauuucguaggaaagauccagggcguucugacccagacuacaaagggcgacgggagcacccgcggacauaaggcuacgguguacaccgguucugcccccuuuacaccuaaauugggcuccguccaguucucaacugacaccgaaaacgauuuugagacacaccaaaauacuaaguucaccccagugggggucauccaggacggaggcacaacccaccgaaacgaaccccagcaaugggugcucccgagcuacagugguagaaauguucauaacgugcaccuggccccugcaguagcuccaacuuuucccggggagcaguuacuguucuuuaggucuacgaugccuggcuguuccggauaucccaauauggaucucgacugccuucugccacaggaguggguccagcauuucuaccaagaagcggccccugcacagagcgauguggcuuugcuacgguuuguuaaccccgacacaggccgugugcuguucgaguguaaacuccacaagucgggguaugucaccguggcccacacuggacagcaugaucugguaauuccaccgaaugguuacuuucgcuucgacucuugggugaaccaguucuauacccuugcaccuaugggcaacgggacaggaagaaggcgggcccuguga

SEQ ID NO: 19726 - RNA, 1623 nt, Artificial Sequence
  derived and/or modified sequence opt3 from major_capsid_protein__Norovirus__AFU92676
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacucuuacgccggcgguuucgaagugcaggucauucuagcggggaaugcauuuacugccggaaaaaucauuuucgcugccgugccuccaaacuuuccgacggagggccucucgcccucacagguaaccauguucccucacaucauaguugacgugcgccaacuggagccaguccuuaucccccugccugaugugcgaaauaacuuuuaucauuacaaucagagcaacgacccaacaauuaaguugaucgcaaugcucuauacuccccugcgugcuaauaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaacucccgcuuuccaauaccccuggagaaacuuuucacggggccuucaagugcguucgugguucagccacagaauggaagauguacuaccgaugguguguugcugggcacaacucaacuaagcccggucaacauuugcaccuuuaggggagacgugacacacaucgccgggacccaggaguacacgaugaaucucgcaucucagaacuggaauaacuaugaucccacugaagagauuccugcuccacugggcacacccgacuucguagguaagauccaggggguucuuacccaaacuacaucccgggacggaucaacccgcggccauaaggccacggugagcaccggcaguguccacuuuacaccuaagcuggggcgagugcaguucucuacugauaccuccaaugacuuugaaacaggacagaacacuagauucaccccagucggugugguucaagauggcagcacaacccaccagaaugagccccagcaguggguguugccgaacuacucggggagggacucucauaauguacaccucgcuccugccgucgcaccauccuuucccggagaacaacuguuauucuuucggucaacuaugccuggcuguagugguuaccccaacaugaaucuggauugccuccuuccacaggagugggugcagcauuucuaucaggaggccgcuccugcgcaaagcgacguugcacuguugcguuuugugaaccccgauacggggcgcguccuauucgaauguaaacugcacaaguccggcuacgugacaguagcccacaccggacagcaugaccucgugaucccaccgaauggcuauuuuagauucgauucuuggguuaaccaguucuacacucuggcuccuauggggaacggaaccgguaggcggcgagcccuuuga

SEQ ID NO: 19727 - RNA, 1623 nt, Artificial Sequence
  derived and/or modified sequence opt3 from major_capsid_protein__Norovirus__AFU92677
augaagauggccagcaacgacgcucaccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuucaccaaggaaugcccccggggagauccuuuggagugcuccucugggaccagauuugaaccccuacuuaagccaucuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucacaucauaguugacgugcgccaacuggagccaguccuuaucccccugccugaugugcgaaacaauuuuuaucauuacaaccagucgaaugacucaaccauuaaguugaucgcuaugcucuauacaccacugcgugccaacaacgcgggggaagauguguucacugucagcugcagaguucugaccaggcccaguccggacuuugauuucauuuuucucgugccucccacaguagagucccggaccaaaccauucacugugccuaucuuaacagucgaagagaugaccaauucucgcuuucccauaccacuggagaaacuuuucacgggacccagcggugccuucgugguucagccucagaacggcagauguacuaccgacgggguguugcugggaacaacucaacuauccccagucaauauuugcaccuuuaggggcgaugugacacacaucgcagguucacggaacuacaccaugaaucucgcuagucugaacuggaauaacuaugacccgacggaagagauucccgccccucuugggacuccagauuucguaggaaagauccagggcguucugacacagaccacuaagggcgacgggagcacacgcggacauaaggcuaccguguacacggguucugcccccuuuaccccuaaauugggcuccguccaguucucaacagacacugaaaaugauuuugagacccaccaaaacacaaaguucacuccagugggggucauccaggacggaggcaccacacaccgaaaugaaccccagcaaugggugcucccgagcuacagugguagaaacguucauaaugugcaccuggccccugcaguagcuccaaccuuucccggggagcaguuacuguucuuuaggucuacuaugccuggcuguuccggauaucccaacauggaucucgacugccuucugccacaggaguggguccagcauuucuaccaagaagcggccccugcacagagcgauguggcuuugcuacgguuuguuaaucccgacacgggccgugugcuguucgaguguaaacuccacaagucgggguaugucacaguggcccacaccggacagcaugaucugguaauuccaccgaacgguuacuuucgcuucgacucuugggugaaccaguucuauacucuugcaccuaugggcaaugggaccggaagaaggcgggcccuguga

SEQ ID NO: 19728 - RNA, 1623 nt, Artificial Sequence
  derived and/or modified sequence opt3 from major_capsid_protein__Norovirus__AFU92678
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaggcaccacacaccgaaacgaaccccagcaaugggugcucccgagcuacagugguagaaauguucacaacgugcaucuggccccugcaguagcuccaaccuuucccggggagcaguuacuguucuuuaggucuacuaugccuggcuguuccggauaucccaauauggaucucgacugccuucugccacaggaguggguccagcacuucuaccaagaagcggccccugcacaguaugauguggcuuugcuacgguuuguuaaccccgacacgggccgugugcuguucgaguguaaacuccauaagagcggguacgucacaguggcccacaccggacagcacgaucugguaauuccaccgaacgguuauuuucgcuucgacucgugggugaaucaguucuacacucuugcaccuaugggcaacgggaccggaagaaggcgggcccuguga

SEQ ID NO: 19729 - RNA, 1623 nt, Artificial Sequence
  derived and/or modified sequence opt3 from major_capsid_protein__Norovirus__AFU92679
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggaguuugacuucauuuuucucgugccucccacaguagaaucccggaccaaaccauucacugugccuaucuuaacagucgaggagaugaccaacucucgcuuucccauaccacuggaaaaacuuuucacgggacccagcggugccuucgugguucagccucagaauggcagauguacuaccgaugggguguugcugggaacaacucaacuauccccagucaacauuugcaccuuuaggggcgacgugacacauaucgcagguucacggaauuacaccaugaaccucgcuagucugaauuggaacaauuaugauccgacggaggaaauucccgccccucuugggacuccagacuucguaggaaagauccagggcguucugacacagaccacuaagggcgaugggagcacacgcggacacaaggcuaccguguacacggguucugcccccuuuaccccuaaauugggcuccguccaguucucaacagacacugagaacgacuuugaaacccaucaaaauacaaaguucacuccagugggggucauccaggauggaggcaccacacaccgaaacgagccccagcaaugggugcucccgagcuacagugguagaaauguucacaacgugcaucuggccccugcaguagcuccaaccuuucccggggagcaguuacuguucuuuaggucuacuaugccuggcuguuccggauaucccaauauggaccucgauugccuucugccacaggaauggguccagcacuucuaccaagaggcggccccugcacagagcgacguggcuuugcuacgguuuguuaaccccgauacgggccgugugcuguucgaauguaaacuccauaagucgggguaugucacaguggcccacaccggacagcacgaccugguaauuccaccgaacgguuacuuucgcuucgauucuugggugaaucaguucuauacucuugcaccuaugggcaacgggaccggaagaaggcgggcccuguga

SEQ ID NO: 19730 - RNA, 1623 nt, Artificial Sequence; identical to SEQ ID NO: 18730
  derived and/or modified sequence opt3 from major_capsid_protein__Norovirus__AFU92680

SEQ ID NO: 19731 - RNA, 1623 nt, Artificial Sequence; identical to SEQ ID NO: 18125
  derived and/or modified sequence opt3 from major_capsid_protein__Norovirus__AFU92681

SEQ ID NO: 19732 - RNA, 1623 nt, Artificial Sequence; identical to SEQ ID NO: 18125
  derived and/or modified sequence opt3 from major_capsid_protein__Norovirus__AFU92682

SEQ ID NO: 19733 - RNA, 1623 nt, Artificial Sequence; identical to SEQ ID NO: 18809
  derived and/or modified sequence opt3 from major_capsid_protein__Norovirus__AFU92684

SEQ ID NO: 19734 - RNA, 1623 nt, Artificial Sequence
  derived and/or modified sequence opt3 from major_capsid_protein__Norovirus__AFU92685
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguccggucaauauuugcaccuuucggggagacguggcccauaucgcaggcacacaggaguacaccaugaaccucgcuagccagaauuggaacaauuaugaucccacggaagagauuccugccccacuggguacucccgacuucguagggaagauccagggaguucuuacacaaaccacucgccgagacggcucuacaagaggccacaaagcuaccguguccacggggucaguccauuuuaccccuaagcugggaaggauccaguucagcacagauacuagcaacgacuuugaaaccggucagaauacacgguucacuccagugggcgucgugcaagaugggggaaccacacaccagaacgagccccagcaguggguuuugccggacuacucuggccgugauucccacaaugugcaucucgccccugcaguagccccaaguuuucccggugaacaacuguuauucuuucgcucgaccaugccuggguguucuggcuaccccaacaugaaucuggacugccuccuuccacaggaguggguccagcacuucuaucaggaggcugcgccugcacaauccgauguggcccuguugagauuuguuaaccccgacacuggaagggugcuauucgaauguaagcugcauaaaucaggcuacgucacgguggcucacacagggcagcacgaucucguaauuccaccgaauggauauuuucgguucgacaguugggugaaccaguucuacacccuggccccuauggguaacggcacugggcgacgcagagcacuuuga

SEQ ID NO: 19735 - RNA, 1623 nt, Artificial Sequence
  derived and/or modified sequence opt3 from major_capsid_protein__Norovirus__AFU92686
augaagauggccagcaacgacgcucaccccuccgauggcucugcagccacccuggugccuaaagucaauaacgagguuauggcgcucgaaccagugguaggggcugccaucgcagccccgguggcuggacagcaaaaugucauugaccccuggauaagaaacaauuucgugcaggcaccugguggcgaguuuacaguuucaccaaggaacgcccccggggaaauccuuuggagugcuccucugggaccagauuugaaucccuacuuaagccaucuggcccggauguauaacggcuacgcggguggguucgagcuacacgugcuccuggcaggaaaugccuuuacugcuggcaagauuaucauugccgcagucccuccaaacuucccgacggaaggccuuucccccucucaggugaccauguuuccucauaucauaguagacguucgccagcuggagccaguguugaucccccucccugauguccgaaauaacuucuaucacuacaaucaaucgaacgacucaacaauuaaacugaucgcuaugcuguauacuccacuccgugccaauaacgcgggggaggauguguuuaccgugagcugcagagucuuaacaaggcccaguccggacuucgauuuuauuuuccugguuccucccaccguggaaucccggacuaagccauuuacaguaccuauccuuaccguggaggaaaugacgaacucucgcuuccccauaccauuggagaaacuguuuacuggacccagcggugccuucgucgugcagccucagaauggcagauguaccacagacgggguucuacucggaacuacccagcuguccccagugaacauuugcaucuucaggggcgaugucacacauauugcagguucacggaauuacaccaugaaccuugcugcccugaauuggaacaauuaugacccgacggaggaaauccccgcuccuuuggggacuccagauuuugugggaaagauccaaggcguacucacacagaccacuaagggcgacgggaguacacgcggacacaaagccaccguuuacacggguagcgcagacuucacccccaagcugggcucugugcaguuuuccacagauacugagaacgacuucgaaacccaccagaauacaaaauuuacuccugucggggugauucaagauggaucaaccacacaucgaaacgagccacagcagugggucuuacccagcuacaguggcagaaaugugcacaacguucaucuggccccggcuguggcgccuaccuucccaggugaacaacuccuguuuuucaggucuacuaugcccggguguuccggcuauccuaauauggaccuugauugcuugcuaccccaggaguggguacagcacuuuuaccaggaggcagccccagcucaaagcgacgucgcccugcuccgguucgugaacccugauacgggacguguucuguuugaauguaaacuucacaagucgggcuaugugacagucgcacauaccgggcagcacgaccuggugauacccccaaauggauacuuccgcuuugauucuuggguaaaccaguucuauacuuuggccccgauggguaacggcaccgggagaaggcgggcucucuga

SEQ ID NO: 19736 - RNA, 1623 nt, Artificial Sequence
  derived and/or modified sequence opt3 from major_capsid_protein__Norovirus__AFU92687
augaagauggccagcaacgaccccaauccuuccgauggcucugcugcaaaccuggugccagaggucaauaacgaaguuauggcccucgagccggugguaggggcggcuaucgccgcacccguggccggacagcaaaaugucauugacccuuggauaagaaacaauuucgugcaggcuccagguggcgaauuuaccguuucacccaggaacgcaccuggggagauccuuuggagugccccacugggacccgauuugaauccuuacuuaagccaccuggcucggauguauaacggcuacgccgguggguucgaagugcaggucauucuagcgggaaaugcauuuacagccggcaaaaucauuuucgcugccgugccaccgaacuuucccacugagggccucuccccuucucagguaacgauguucccacauaucauaguugacgugcgccaacuggagcccguccuuaucccucugccagaugugcgaaauaacuuuuaucacuacaaucagucgaacgacucaaccauuaaguugaucgcaaugcucuauacaccccugcgugcuaacaaugccggggaagauguguucacugucagcugcagaguucugaccaggccgaguccugacuuugauuucauuuuucucgugcccccaacaguagagucccggaccaaaccuuucacugugcccaucuuaacagucgaagagaugaccaacucucgcuuuccaauaccccuggagaaacuuuucacgggaccuagcggugcguucgugguucagccacagaauggcagauguacuaccgacgggguguugcugggaacaacucaacuauccccggucaacauuugcaccuuuaggggcgaugugacacauaucgccgguacccggaauuacacgaugaaccucgcaucacugaauuggaacaauuaugaccccacugaagagauuccugcuccacuugggacacccgauuucguaggaaagauccagggcguucugacccagacuacaaagggcgacgggaguacccgcggacacaaggccacgguguacaccgguagcgcuccuuuuacaccaaaauugggcucuguccaguucuccacugacaccgaaaacgauuuugagacacaucaaaauacuaaguucacccccgugggggucauccaggacggaggcacaacccaccgaaacgaaccgcagcaaugggugcucccuucauacagcgguagaaauguucacaacgugcaucuggccccagcaguagcccccacuuuuccuggggagcaguuacuguucuuuaggaguacgaugcccggcuguucuggauauccaaauauggaucucgacugccuucugccucaggaguggguccagcacuucuaccaagaagcugcgcccgcacaguccgauguggccuugaugcgguuuguuaacccagacacaggccgugugcuauucgaguguaaacugcauaagagcggguaugucaccguggcucacacuggacagcacgaucucguaauuccgccuaacgguuacuuucgcuucgacucgugggugaaucaguucuauacccuggcccccaugggcaacgggacaggaagaaggcgggcacuuuga

SEQ ID NO: 19737 - RNA, 1623 nt, Artificial Sequence
  derived and/or modified sequence opt3 from major_capsid_protein__Norovirus__AFU92688
augaagauggccagcaacgacgcucaccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuucaccaaggaaugcccccggggagauccuuuggagugcuccucugggaccagauuugaaccccuacuuaagccaucuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucacaucauaguugacgugcgccaacuggagccaguccuuaucccccugccugaugugcgaaacaauuuuuaucauuacaaccagucgaaugacucaaccauuaaguugaucgcuaugcucuauacaccacugcgugccaacaacgcgggggaagauguguucacugucagcugcagaguucugaccaggcccaguccggacuuugauuucauuuuucucgugccucccacaguagagucccggaccaaaccauucacugugccuaucuuaacagucgaagagaugaccaauucucgcuuucccauaccacuggagaaacuuuucacgggacccagcggugccuucgugguucagccucagaacggcagauguacuaccgacgggguguugcugggaacaacucaacuauccccagucaauauuugcaccuuuaggggcgaugugacacacaucgcagguacccggaacuacacgaugaaucucgcuucacugaacuggaauaacuaugacccgacugaagagauucccgccccucuugggccacccgauuucguaggaaagauccagggcguucugacacagaccacuaagggcgacgggaguacacgcggacauaaggcuaccguguacacggguagcgccccuuuuaccccaaaauugggcucuguccaguucuccacagacacugaaaaugauuuugagacccaccaaaacacaaaguucacucccgugggggucauccaggacggaggcaccacacaccgaaaugaaccgcagcaaugggugcucccuucauacagcgguagaaacguucauaaugugcaccuggcaccagccguagcucccaccuuuccuggggagcaguuacuguucuuuaggaguacuaugcccggcuguucuggauauccaaacauggaucucgacugccuucugccucaggaguggguccagcauuucuaccaagaagcggcacccgcccaguccgauguggcuuugaugcgguuuguuaauccagacacgggccgugugcuauucgaguguaaacugcacaagagcggguaugucacaguggcccacaccggacagcaugaucucguaauuccgccuaacgguuacuuucgcuucgacucgugggugaaccaguucuauacucuggcacccaugggcaaugggaccggaagaaggcgggcccuuuga

SEQ ID NO: 19738 - RNA, 1623 nt, Artificial Sequence; identical to SEQ ID NO: 18152
  derived and/or modified sequence opt3 from major_capsid_protein__Norovirus__AFU92689

SEQ ID NO: 19739 - RNA, 1623 nt, Artificial Sequence; identical to SEQ ID NO: 18152
  derived and/or modified sequence opt3 from major_capsid_protein__Norovirus__AFU92690

SEQ ID NO: 19740 - RNA, 1623 nt, Artificial Sequence; identical to SEQ ID NO: 18152
  derived and/or modified sequence opt3 from major_capsid_protein__Norovirus__AFU92691

SEQ ID NO: 19741 - RNA, 1623 nt, Artificial Sequence; identical to SEQ ID NO: 18809
  derived and/or modified sequence opt3 from major_capsid_protein__Norovirus__AFU92692

SEQ ID NO: 19742 - RNA, 1623 nt, Artificial Sequence
  derived and/or modified sequence opt3 from major_capsid_protein__Norovirus__AFU92693
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacauggaucucgacugccuucugccucaggaguggguccagcauuucuaccaagaagcggcacccgcccagucugauguggcuuugcuacgguuuguuaauccagacacgggacgugugcuguucgaguguaaacuccacaaguccggcuaugucacaguggcccauaccgggcagcacgaucugguaauuccgccuaacggauacuuucgcuucgacucaugggugaaccaguucuauacucuugcacccauggguaauggcaccgggagaaggcgggcccuguga

SEQ ID NO: 19743 - RNA, 1623 nt, Artificial Sequence; identical to SEQ ID NO: 18202
  derived and/or modified sequence opt3 from major_capsid_protein__Norovirus__AFU92694

SEQ ID NO: 19744 - RNA, 1623 nt, Artificial Sequence; identical to SEQ ID NO: 18261
  derived and/or modified sequence opt3 from major_capsid_protein__Norovirus__AFU92695

SEQ ID NO: 19745 - RNA, 1623 nt, Artificial Sequence; identical to SEQ ID NO: 18787
  derived and/or modified sequence opt3 from major_capsid_protein__Norovirus__AFU92696

SEQ ID NO: 19746 - RNA, 1623 nt, Artificial Sequence; identical to SEQ ID NO: 18261
  derived and/or modified sequence opt3 from major_capsid_protein__Norovirus__AFU92697

SEQ ID NO: 19747 - RNA, 1623 nt, Artificial Sequence; identical to SEQ ID NO: 18112
  derived and/or modified sequence opt3 from major_capsid_protein__Norovirus__AFU92698

SEQ ID NO: 19748 - RNA, 1623 nt, Artificial Sequence
  derived and/or modified sequence opt3 from major_capsid_protein__Norovirus__AFU92699
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauacuggacguucgccaacuugagccagugcugauccccuugccugauguccgaaauaacuuuuaucacuacaaucagucgaacgacucaaccauuaagcucaucgcuaugcuguauacaccacugcgugccaacaaugcgggggaagauguguucacugugagcugcagaguccucaccaggcccaguccggacuuugauuucauuuuucugguuccucccacaguggagucccggaccaaaccauucacuguaccuauccugacaguggaagagaugaccaacucucgcuuucccauaccacuugagaaguuguucacgggacccagcggugccuucgucgugcagccucagaauggcagauguacuaccgacgggguucugcuaggaacaacucaacucuccccagugaacauuugcaccuuuaggggcgaugucacacauaucgcagguucacggaauuacaccaugaaccuggcuagucuuaauuggaacaauuaugacccgacggaagagauucccgccccucuggggacuccagauuucgugggaaaaauccagggcguauugacacagaccacuaagggcgacgggagcacacgcggacacaaggcuaccguuuacacggguucugcccccuuuaccccuaaacucggcuccgugcaguucucaacagacacugaaaacgauuuugagacccaucaaaauacaaaguucacuccagucggggugauccaggacggaagcaccacacgaagaaacgaaccccagcaauggguccugccgaguuacucuggcaggaaugcacacaacgugcacuuagccccugcuguugcgccaaccuuucccggugagcaguuacucuucuuucgguccacuaugccuggguguagcggcuaucccaauauggaucuugacugccuguugccacaggagugggugcagcauuucuaccaagaagcagccccugcucagucggauguagcccuacugcguuuugucaaccccgacacgggacgcguucucuucgaguguaaacugcacaagucuggcuaugugacaguggcacauaccgggcagcacgaucuugucauuccaccgaacggauacuuuagauucgacuccugggugaaucaguucuauacucuggccccuauggguaacggcaccgggaggcggcgagcuuuguga

SEQ ID NO: 19749 - RNA, 1623 nt, Artificial Sequence
  derived and/or modified sequence opt3 from major_capsid_protein__Norovirus__AFU92700
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccgggacuacaccaugaaccucgcuucucugaauuggaacaauuaugauccgacggaagagauucccgccccucuugguacuccagacuucguagggaagauccagggaguucugacacagaccacuaagggcgacggcuccacacgcgggcacaaggcuaccguguacacgggaucagcccccuuuaccccuaaauuggguagcguccaguucaguacagauacugaaaacgacuuugagacccaucaaaauacaaaguucacuccagugggcgucauccaggaugggucuaccacacaccgaaacgaaccccagcaaugggugcucccguccuacagcggaagaaauguucagaacgugcaccuggccccugcaguagcuccaaccuuucccggcgagcaguuacuguucuuuaggucgacuaugccugguuguucuggguaucccaauauggaccucgauugccuucugccacaggaguggguccaacauuucuaccaggaagcggccccugcacaguccgacguggcuuugcuacgguuuguuaaccccgauacgggccgugugcuguucgaguguaaacuccacaagucaggauaugucacaguggcccauaccggccagcacgaccugguaauuccaccgaauggguacuuucgcuucgauaguugggugaaccaauucuauacucuugcaccuaugggaaacgguaccggcagaaggcgggcccuguga

SEQ ID NO: 19750 - RNA, 1623 nt, Artificial Sequence; identical to SEQ ID NO: 18261
  derived and/or modified sequence opt3 from major_capsid_protein__Norovirus__AFU92701

SEQ ID NO: 19751 - RNA, 1623 nt, Artificial Sequence; identical to SEQ ID NO: 18202
  derived and/or modified sequence opt3 from major_capsid_protein__Norovirus__AFU92702

SEQ ID NO: 19752 - RNA, 1623 nt, Artificial Sequence
  derived and/or modified sequence opt3 from major_capsid_protein__Norovirus__AFU92703
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagaaaugugcagaacguucaccuggccccugcaguggcuccaaccuuucccggcgagcaguuacuguucuuuaggagcacuaugccugguuguucgggguaucccaauauggaucucgacugccuucugccacaggaguggguacaacauuucuaccaggaagcggccccugcacagucugaugucgcuuugcuacgguuugugaaccccgacacgggccguguucuguucgaguguaaacuccacaaguccggauaugugacagucgcccauaccggccagcacgaucuggugauuccaccgaacggguacuuucgcuucgacucauggguaaaucaauucuauacucuugcaccuaugggaaacgguaccggcagaaggcgggcccuguga

SEQ ID NO: 19753 - RNA, 1623 nt, Artificial Sequence
  derived and/or modified sequence opt3 from major_capsid_protein__Norovirus__AFU92704
augaagauggccagcuccgacgcuaaccccucugauggcucaaccgcacaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucauaguugacgugcgccaacuggagccaguccuuaucccccugccugaugugcgaaauaacuuuuaucauuacaaucagucaaacgacccaacaauuaaguugaucgcaaugcucuauacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacacauucccggcagccggaauuacaccaugaaccucgccucucagaauuggaacuccuaugauccuacggaggaaaucccagcaccccuggguacuccugacuucguugggaagauucagggagugcuuacacagaccacucgcacaaauggcucaacccgaggccauaaggcuacggucuacaccgggagcgccgacuuuaguccaaagcugggaagagugcaauucgcuacagauacugacaacgauuuugagaccaaucagaacacaaaauucacucccgucggugugauccaggacggcucuaccacaccgaggaaugaaccucaacaguggguuuugccauccuacagcgggcggaacauccacaaugugcaccucgcccccgcaguagccccuaccuuucccggagagcagcuguuauucuuucguucgacuaugccaggcuguucugguuauccuaacauggaucuggacugccuccuuccccaggaauggguccaauacuucuaucaggaggcugcgccagcacaguccgauguggcccuguugcgcuuuguuaauccggacacggggagagugcuauucgaguguaagcugcauaaaucaggcuacgucacaguggcucacaccggacagcaugaucucguaauuccucccaacggcuauuuuagguucgacaguugggugaaccaauucuacacucuggccccaauggggaauggaaccggucggcgacgcgcacuuuga

SEQ ID NO: 19754 - RNA, 1623 nt, Artificial Sequence; identical to SEQ ID NO: 18112
  derived and/or modified sequence opt3 from major_capsid_protein__Norovirus__AFU92705

SEQ ID NO: 19755 - RNA, 1623 nt, Artificial Sequence; identical to SEQ ID NO: 17702
  derived and/or modified sequence opt3 from major_capsid_protein__Norovirus__AFU92706

SEQ ID NO: 19756 - RNA, 1623 nt, Artificial Sequence
  derived and/or modified sequence opt3 from major_capsid_protein__Norovirus__AFU92707
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagaguggaguucgcuacagauacugacaaugauuuugaaaccaaccaaaauacaaaauucacucccgucggugugauccaggacggcucuaccacaccgaggaacgagccucagcaauggguuuugccauccuacagcgggcggaauauccauaacgugcaccucgcccccgcaguagccccuaccuuucccggagaacagcuguuauucuuucguucgacuaugccaggcuguucugguuauccuaauauggaucuggacugccuccuuccccaggaguggguccaguacuucuaucaagaggcugcgccagcacaguccgauguggcccuguugcgcuuuguuaacccggacacggggagagugcuauucgaauguaagcugcacaaaucaggcuacgucacaguggcucauaccggacagcacgaucucguaauuccucccaacggcuauuuuagguucgacaguugggugaaucaguucuacacucuggccccaauggggaacggaaccggucggcgacgcgcacuuuga

SEQ ID NO: 19757 - RNA, 1623 nt, Artificial Sequence
  derived and/or modified sequence opt3 from major_capsid_protein__Norovirus__AFU92708
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcugcccugaauuggaacaauuaugacccgacggaagagauucccgcuccucuugggacuccagauuucguaggaaagauccagggcguucugacacagaccacuaagggcgacgggaguacacgcggacacaaggccaccguguacacggguagcgcagacuuuacccccaaauugggcucuguccaguucuccacagauacugaaaacgacuuugagacccaucaaaauacaaaguucacuccugugggggucauccaggauggaucaaccacacaccgaaacgaaccacagcaaugggugcuccccagcuacaguggcagaaauguucacaacgugcaucuggccccggcuguagcgccuaccuuuccaggugagcaguuacuguucuuuaggucuacuaugcccggguguuccggcuauccuaauaugaaccucgacugccuuauuccccaggaguggguccagcacuucuaccaagaagcagccccagcucagagcgauguggcccuguugcgguuuguuaacccugacacgggacgugugcuauucgaguguaaacugcauaagucgggcuaugucacaguggcacacaccgggcagcacgaucucguaauacccccaaauggauacuuucgcuucgacucuugggugaaccaguucuauacucuggccccgauggguaauggcgcugggagaaggcgggcccuuuga

SEQ ID NO: 19758 - RNA, 1623 nt, Artificial Sequence; identical to SEQ ID NO: 17702
  derived and/or modified sequence opt3 from major_capsid_protein__Norovirus__AFU92709

SEQ ID NO: 19759 - RNA, 1623 nt, Artificial Sequence; identical to SEQ ID NO: 17702
  derived and/or modified sequence opt3 from major_capsid_protein__Norovirus__AFU92710

SEQ ID NO: 19760 - RNA, 1623 nt, Artificial Sequence; identical to SEQ ID NO: 17702
  derived and/or modified sequence opt3 from major_capsid_protein__Norovirus__AFU92711

SEQ ID NO: 19761 - RNA, 1623 nt, Artificial Sequence
  derived and/or modified sequence opt3 from major_capsid_protein__Norovirus__AFU92712
augaagauggccagcaacgacgcuaaucccuccgagggcucugcagccaaccuggugccugaagucaauaacgagguuauggcgcucgaaccagugguaggggcugccaucgcagccccgguggcuggacagcaaaaugucauugaucccuggauaagaaacaauuucgugcaggcaccugguggcgaguuuaccguuucaccaaggaacgcccccgggacaauccgguggagugcuccucuuggaccagaccugaaucccuacuugagccacuuagcccgcauguauaacggcuacgcggguggguucgaagugcaggucauucuggcaggaaaugccuuuacugcuggcaaaaucauuuucgccgcagugccuccaaacuuuccgacggagggccuaucccccucucagguaaccauguucccucauaucauaguugaugugcgacaacucgagccaguccugaucccccuuccugacgugcguaauaacuuuuaucacuacaaucagucgaacgauucaacaauuaagcugaucgcuauguuguauacuccacucagagccaacaaugcgggggaagacguguucaccgucagcugcaggguucugacacggcccaguccggauuuugacuucauuuuucuggugccucccaccguagagucccgcacuaaaccauucacagugccuauccucaccgucgaagagaugacgaacucuagauuuagcauacccuuagagaagcuguucacuggaccauccggugccuucgugguucagccccagaaugggagguguaccacagauggcgugcuuuugggaacuacccaacugucaccugucaacauuugcacauuucggggcgacgugacccauaucgcagguagucgcaauuacacgaugaaccuagcugcccucaauuggaacaauuaugauccaacugaagagauuccggcuccccuggggacaccugacuucguaggaaaaauccagggcguucuuacccagacuacaaagggcgaugggagcacccgaggacacaaggccacgguguacaccgguucugcagacuuuacaccaaaacugggcuccguccaguucucaacugacaccgaaaacgauuuugagagccaucaaaauacaaaguucacucccgugggggucauccaggacggaaguaccacacacagaaacgaaccucagcaauggguguugccaucuuacuccggcaggaauguucacaacgugcaucucgcccccgcuguagcgccgaccuuuccuggugagcagcuguuauucuuucggagcacuaugccaggguguucgggcuaucccaauauggaucuggacugccucauuccucaggaguggguccagcacuucuaccaagaagcagcccccgcucagucugauguggcccuucugcguuuuguuaacccagacacgggacgcguguuguucgaguguaaacuacauaaguccggcuaugucacaguggcacacaccgggcagcacgaucugguaauaccucccaacggauacuuuagauucgacucaugggugaaucaguucuauacucucgccccaauggguaacggcgcugggaggcggcgagcccuguga

SEQ ID NO: 19762 - RNA, 1623 nt, Artificial Sequence
  derived and/or modified sequence opt3 from major_capsid_protein__Norovirus__AFU92713
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuucaaucccacuggagaaacuuuucacgggacccaguagcgcguucguugugcagccucagaaugguagauguacuaccgauggcgucuugcuggggacaacucaacuaucuccagugaacauaugcaccuuuaggggagacguaacacauauuccgggcucccggaauuacaccaugaaccucgccucacagaauuggaacagcuaugaucccacggaggaaaucccugcaccacuggguacucccgacuucguugggaagauucagggagugcuuacacagaccacucgcacaaauggcaguacccgaggccacaaggcuacggucuacaccgggucugccgacuuuuccccuaagcugggaagagugcaauucgcuacagauacugacaacgauuuugagaccaaucagaacacaaaauucacuccagucggugugauccaggacggcagcaccacacccaggaaugaaccgcaacaguggguuuugccuucguacucugggcggaacauccauaaugugcaccucgccccagcaguagcccccaccuuuccuggagagcagcuguuauucuuucguuccacuaugcccggcuguucagguuauccaaacauggaucuggacugccuccuuccucaggaauggguccaauacuucuaucaggaggcugcgcccgcacagagugauguggcccuguugcgcuuuguuaauccagacacggggagagugcuauucgaguguaagcugcacaaaagcggcuacgucacaguggcucauaccggacagcacgaucucguaauuccgccuaacggcuauuuuagguucgacuccugggugaaccaauucuacacucuggcccccauggggaauggaaccggucggcgacgcgcacuuuga

SEQ ID NO: 19763 - RNA, 1623 nt, Artificial Sequence; identical to SEQ ID NO: 17702
  derived and/or modified sequence opt3 from major_capsid_protein__Norovirus__AFU92714

SEQ ID NO: 19764 - RNA, 1623 nt, Artificial Sequence
  derived and/or modified sequence opt3 from major_capsid_protein__Norovirus__AFU92715
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuuccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaauuccgccuaacggcuauuuuagguucgacagcugggugaaucaauucuacacucuggcccccauggggaacggaaccggucggcgacgcgcacuuuga

SEQ ID NO: 19765 - RNA, 1623 nt, Artificial Sequence
  derived and/or modified sequence opt3 from major_capsid_protein__Norovirus__AFU92717
augaagauggccagcuccgaccccaacccuucugauggcucaaccgcuaaucuggugccagaggucaacaaugaaguuauggcacucgagccggugguaggggccgcgaucgcugcccccguggcaggacagcaaaacgucauugacccuuggauaagaaauaacuucgugcaggccccagguggcgaauuuacaguuagucccaggaaugcuccuggggagauccuuuggagcgcaccacugggacccgauuugaacccuuacuuaucccaccuggcccggauguauaauggcuacgcugguggguucgaagugcaggucauucuagccggaaacgcguuuacugcaggcaaaaucauuuucgccgcugugccaccgaauuuucccacggagggccucucuccuucgcagguaaccauguucccacauaucauaguugacgugcgccaacuggagcccguccuuaucccucugccagaugugcgaaacaauuuuuaucacuacaaccagucaaaugacagcaaguugaaacuccgucccaugcuguauacaccgcugagagccaacaacgcaggggaugacguguucacugucaguugcaggguucucacccggccuucccccgauuuugacuucaucuuuuuagugccaccuacaguagaaucucgcaccaagcccuucagcgugccaguccugacuguggaggaaaugacaaauuccagauuucccaucccucuugagaaauuguucaccggaccaucaagugcuuucguugugcagccgcagaacgguagguguacgacugauggcguccugcuagggaccacacaacucagccccgugaauauuugcacuuuucggggagacguaacccauaucccuggcucucgcaacuacacaaugaaucuggccucccagaacuggaacucauaugauccaaccgaggaaauacccgcgccucuugguacgccagacuucguugggaagauucagggagugcugacucagacaacccgaacuaauggcagcacaagaggccacaaggccaccgucuacacggggagugcagacuuuucucccaaauugggaagggugcaauucgcuaccgauacagacaaugauuuugagacuaaccagaauaccaaguucacaccggucggugugauccaggacggcuccacuaccccucggaacgaaccacaacaguggguucuccccagcuacucggggcguaauauucauaacgugcaccuggccccugcuguagcccccacauuuccaggagagcaguuacuguucuuucgcucuaccaugccuggcuguuccgguuaucccaauauggaucucgacugccuucugccacaggaauggguccaauacuucuaucaggaggcagccccggcucagucagauguggcguugcuaagauuuguuaacccugacacugggagggugcuguucgaguguaaacuccacaagaguggcuacgucacgguggcacauacaggacagcacgaucugguaauucccccaaacggcuauuuucgguucgacagcugggugaaucaauucuacacccuugcccccauggggaacggaacuggucgacgcagagcucuguga

SEQ ID NO: 19766 - RNA, 1623 nt, Artificial Sequence
  derived and/or modified sequence opt3 from major_capsid_protein__Norovirus__AFU92718
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagccucgauuuugacuucaucuuuuuagugccucccaccguagaaagucggacuaaaccauucuccgugccuguccugacaguggaggaaaugaccaacucucgcuuucccauuccacuugagaaguuguucacgggacccagcuccgcguucguugugcagccucagaaugguagauguacuaccgauggcguccugcuagggacaacucaacucucaccagugaacauaugcaccuuuaggggagacguaauucauaucccgggcagucggaauuacacaaugaaccuggccagccagaauuggaacucuuaugaucccaccgaggaaauuccugcaccacuugguacgcccgacuucguugggaaaauccagggagugcugacucagacaacccgcacuaauggcuccacacgaggccacaaggcuaccgucuacacggggucagccgacuuuagcccuaaguugggaagagugcaauucgcuaccgauacagacaacgauuuugagacuaaucagaacaccaaauucacaccagucggugugauccaggacggcaguacuacccccaggaaugaaccgcaacaguggguucucccuucuuacuccgggcggaacauucauaaugugcaccuggccccagcaguagcccccacauuuccuggagagcaguuacuguucuuucguagcaccaugcccggcuguucggguuauccaaacauggaucucgacugccuucugccucaggaauggguccaauacuucuaucaggaggcugcgcccgcacagucugauguggccuugcuacgcuuuguuaacccagacacugggagagugcuguucgaguguaagcuccacaaauccggcuacgucacgguggcucauacaggacagcacgaucugguaauaccgccuaauggcuauuuuagguucgacucaugggugaaccaauucuacacccuugcccccauggggaauggaacuggucggcgacgcgcacuguga

SEQ ID NO: 19767 - RNA, 1623 nt, Artificial Sequence; identical to SEQ ID NO: 18261
  derived and/or modified sequence opt3 from major_capsid_protein__Norovirus__AFU92719

SEQ ID NO: 19768 - RNA, 1623 nt, Artificial Sequence
  derived and/or modified sequence opt3 from major_capsid_protein__Norovirus__AFU92720
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucauaguugacgugcgccaacuggagccaguccuuaucccccugccugaugugcgaaauaacuuuuaucauuacaaucagucaaacgacccaacaauuaaguugaucgcaaugcucuauacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacacauucccggcagccggaauuacaccaugaaccucgccucucagaauuggaacuccuaugauccuacggaggaaaucccagcaccccuggguacuccugacuucguugggaagauucagggagugcuuacacagaccacucgcacaaauggcucaacccgaggccauaaggcuacggucuacaccgggagcgccgacuuuaguccaaagcugggaagagugcaauucgcuacagauacugacaacgauuuugagaccaaucagaacacaaaauucacucccgucggugugauccaggacggcucuaccacaccgaggaaugaaccucaacaguggguuuugccauccuacagcgggcggaacauccacaaugugcaccucgcccccgcaguagccccuaccuuucccggagagcagcuguuauucuuucguucgacuaugccaggcuguucugguuauccuaacauggaucuggacugccuccuuccccaggaauggguccaauacuucuaucaggaggcugcgccagcacaguccgauguggcccuguugcgcuuuguuaauccggacacggggagagugcuauucgaguguaagcugcauaaaucaggcuacgucacaguggcucacaccggacagcaugaucucguaauuccucccaacggcuauuuuagguucgacaguugggugaaccaauucuacacucuggccccaauggggaauggaaccggucggcgacgcgcacuuuga

SEQ ID NO: 19769 - RNA, 1623 nt, Artificial Sequence
  derived and/or modified sequence opt3 from major_capsid_protein__Norovirus__AFU92721
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucguuguggacguccgccaacuggagccagugcuuauaccccugccugaugugcgaaauaacuuuuaucauuacaaucagucaaacgacccaacaaucaaguugauugcaaugcucuauacuccccugcgugcuaauaacgccggggaugacgucuucaccguuagcugcagagugcugacaaggccgaguccugauuuugacuucaucuuucucguacccccaaccguggaaucccggacuaaaccuuucucuguccccguguuaacaguugaggaaaugaccaacagccgcuuuccaauuccccuggagaaacuuuucacgggaccuuccucagcguucgugguccagccacagaaugguagauguacuaccgauggcguguugcuggggacaacucaacuaaguccgguaaacaucugcaccuuuaggggagacguuacacacauaagcggcucucggaauuacaccaugaaccucgccucccagaauuggaacucauaugaucccacggaggaaauuccugcaccacuggguacucccgacuucguggggaagauccagggaguccuuacacagaccacucgcacagacggcagcacccgaggccauaaggcuacgguguacaccgggagugccgauuuuucuccuaagcugggaagaguccaauucgcuacagacacugauaaugacuuugugaccaaccagaauacaaaauucacuccaguuggugugauucaggauggcuccaccacacccaggaacgagccgcaacaguggguauugccuagcuacucggggcggaauacccacaacguccaccucgccccagcaguggcccccacuuuuccuggagaacagcuguuauucuuucguucuacgaugcccggcuguuccgguuauccaaauauggaccuggauugccuccuuccucaggaguggguucaauacuucuaucaggaagcugcgcccgcacagucagacguggcccuguugcgcuuugucaacccagauacagggagagugcuauucgaguguaagcugcauaaaaguggcuacguaaccguggcucacacuggacagcaugaccucguuaucccgccuaauggcuauuuuagguucgauagcugggucaaccaauucuacacccuggcccccauggggaacggaacaggucggcgacgcgcacuuuga

SEQ ID NO: 19770 - RNA, 1623 nt, Artificial Sequence
  derived and/or modified sequence opt3 from major_capsid_protein__Norovirus__AFU92722
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucauaguucagccacagaacgguagauguacuaccgauggcguguugcuggggacaacucaacuaaguccggucaauauuugcaccuuuaggggagacgugacacauaucagcggcucucggaacuacaccaugaaucucgccucccagaacuggaacucauaugaucccacggaggaaauuccugcaccacuggguacucccgacuucguagggaagauccagggaguucuuacacagaccacucgcacagacggcagcacccgaggccacaaggcuacgguguacaccgggagugccgauuuuucuccuaagcugggaagaguccaauucgcuacagacacugauaaugacuuugugaccaaucagaacacaaaauucacuccagucggugugauccaggauggcuccaccacacccaggaaugagccgcaacaguggguuuugccuagcuacucggggcggaacacccauaaugugcaccucgccccagcaguagcccccacuuuuccuggagaacagcuguuauucuuucguucuacgaugcccggcuguuccgguuauccaaacauggaccuggauugccuccuuccucaggaguggguccaauacuucuaucaggaagcugcgcccgcacagucagacguggcccuguugcgcuuuguuaauccagauacagggagagugcuauucgaguguaagcugcacaaaaguggcuacgucaccguggcucauacuggacagcacgaccucguaauuccgccuaacggcuauuuuagguucgauagcugggugaaccaauucuacacccuggcccccauggggaauggaacaggucggcgacgcgcacuuuga

SEQ ID NO: 19771 - RNA, 1623 nt, Artificial Sequence
  derived and/or modified sequence opt3 from major_capsid_protein__Norovirus__AFU92723
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucguuguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccguguuaacaguugaggaaaugaccaauagccgcuuuccaauuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauaagcggcucucggaacuacaccaugaaucucgccucccagaacuggaacucauaugaucccacggaggaaauuccugcaccacuggguacucccgacuucguggggaagauccagggaguccuuacacagaccacucgcacagacggcagcacccgaggccacaaggcuacgguguacaccgggagugccgauuuuucuccuaagcugggaagaguccaauucgcuacagacacugauaaugacuuugugaccaaucagaacacaaaauucacuccaguuggugugauucaggauggcuccaccacacccaggaaugagccgcaacaguggguauugccuagcuacucggggcggaacacccauaauguccaccucgccccagcaguggcccccacuuuuccuggagaacagcuguuauucuuucguucuacgaugcccggcuguuccgguuauccaaacauggaccuggauugccuccuuccucaggaguggguucaauacuucuaucaggaagcugcgcccgcacagucagacguggcccuguugcgcuuugucaauccagauacagggagagugcuauucgaguguaagcugcacaaaaguggcuacguaaccguggcucauacuggacagcacgaccucguuaucccgccuaacggcuauuuuagguucgauagcugggucaaccaauucuacacccuggcccccauggggaauggaacaggucggcgacgcgcacuuuga

SEQ ID NO: 19772 - RNA, 1647 nt, Artificial Sequence
  derived and/or modified sequence opt3 from major_capsid_protein__Norovirus__AGD79474
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugauugcgaugcuguacacaccccucagagccaauaacucuggagacgauguuuucacugugucguguagggucuuaacccggccuucaccagacuuuagcuucaauuuucuggugcccccgacaguggaaaguaagaccaaaccuuucacucuucccaucuugacaauauccgagaugucuaacagccgcuuuccagucccuauugauucccugcauaccucacccacggaaaauaucguugugcagugccagaacgguagaguaacucuagacggcgagcucauggggaccacacaacugcuuccaagucagauuugugcauucaggggagugcugacucggagcaccucucgcgcuuccgaucaggccgacacagcuacgccccgauuguucaauuauuacuggcacauccagcucgacaaccugaauggcaccccuuaugauccagccgaggacaucccgggucccuuagggacuccugauuuuagaggaaaggucuucggcguggcaucacaaaggaacccagacagcacaacccgggcccaugaagcuaaaguugauacuacagcgggccguuuuacccccaagcuggggagucucgagauuucuacggaauccgacgauuucgaccagaaucagccuacccgcuuuacaccagugggaauaggugucgauagagaggcagacuuccaacaguggagccuucccgauuacucgggccaguuuacucacaacaugaaucuggccccggcuguggccccuaacuucccaggggaacaguugcuauuuuucaggucucaacugcccuccucaggaggccggaguaaugguguacucgacugccugguuccucaggagugggugcagcacuuuuaccaggagagcgcacccgcccaaacccaggucgcucuugugcgauaugucaacccagacacagggcgcgugcuguucgaagccaaguugcauaaacucggcuuuaugacuaucgcaaagaacggagauuccccuauuaccguucccccaaauggcuacuucagauucgagucuugggugaacccguuuuauacacuggcgccuauggggaccggaaaugguaggcggcgcguacaguga

SEQ ID NO: 19773 - RNA, 1647 nt, Artificial Sequence
  derived and/or modified sequence opt3 from major_capsid_protein__Norovirus__AGD79475
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugauuuugccuaugccagacguacgcaacaauuucuuucacuauaaccaggggagcgauucccgacuccgucugaucgcgaugcuguacacaccccucagagccaacaauucuggagacgauguuuucacugugucguguagggucuuaacccggccuucaccagacuuuagcuucaacuuucuggugcccccgacaguggaaaguaagaccaaaccuuucacucuucccauauugacaauuuccgagaugucuaauagccgcuuuccagucccuaucgauucccugcauaccucacccacggaaaacauuguugugcagugccagaaugguagaguaacucuagacggcgagcucauggggaccacacaacugcuuccaagucagaucugugcauucaggggagugcugacucggagcaccucucgcgcuuccgaucaggccgacacagucacgccccgauuguucaacuauuacuggcacauccagcucgacaaucugaacggcaccccuuaugauccagcugaggacauuccgggucccuuagggacuccugauuuuagaggaaagguguucggcguugccucacaaaggaauccagacagcacaacccgggcacaugaagccaaaguggauacuacagcuggccguuuuacccccaagcuggggagucucgagauaucuacggaauccgacgauuucgaccagaaccagccuacccgcuuuacaccagucggaaucgguguggauagagaggcggacuuccaacaguggagccuucccgauuacucgggccaguuuacucacaauaugaaccuggcaccggccguagcuccuaauuucccaggggaacaguugcuauuuuucaggucucaacugcccuccucaggaggccggaguaacgguauucucgacugccugguuccucaggagugggugcagcacuuuuaccaggagagcgcccccgcacaaacccaggucgcccuugugcgauaugucaauccagacacagggcgcgugcuguucgaagcuaaguugcauaaacucggcuuuaugacuaucgccaagaacggagauuccccuauaaccguucccccaaacggcuacuucagauucgagucuugggugaauccguuuuauacacuggcaccuauggggaccggaaacgguaggcggcgcauucaguga

SEQ ID NO: 19774 - RNA, 1647 nt, Artificial Sequence
  derived and/or modified sequence opt3 from major_capsid_protein__Norovirus__AGD79476
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugauugccaugcuguacacuccccucagagcaaauaacucuggagaugacguuuucacagugucguguagggucuuaacucggccuucaccagauuuuagcuucaauuuucuggugcccccgaccguggagaguaagacaaaaccuuucucccuucccaucuugaccauaucugaaaugagcaacucccgcuuuccagucccuauugacucacugcauaccagucccacagagaauaucguugugcagugccagaacgguagaguaacccuagauggcgagcucauggggacgacucaacugcuuccaagccagauuugugcuuucaggggagugcugacccggucuacaucccgcgccucagaccaggcugauacugccacuccccgauuguucaauuauuacuggcacauccagcucgacaaccugaauggcacaccuuaugacccagcagaagauaucccgggucccuuagggaccccugacuuuagaggaaaggucuucggcguggccagccaaaggaacccagauacgacuacacgggcucaugaggcgaaaguugacaccaccaguggccguuuuacacccaagcuggggucucucgaaauuuccaccgagagcgaugacuucgaucagaauaagccuacgcgcuuuaccccagugggaauaggugucgaccacgaagcagauuuccagcaauggacacuucccgacuacgccggccaguuuacucacaacaugaaucuggcuccggccgugguaccuaacuucccaggggagcaguugcuauuuuucagaucgcagcugcccucuuccggaggcaggucaaaugguauccucgauugccugguuccucaagagugggugcagcauuuuuaccaggaaagugcacccagccagucccaagucgcccuugugcgguauauuaacccagacaccgggcgaguccuguucgaggcuaaauugcacaagcucggcuuuaugacaaucgccaaaaacggagacucuccuauaacugugcccccaaauggcuacuuccgcuucgaaagcuggguuaacccguuuuauacccuggcaccuauggggacaggaaaugguagaaggcggauucaguga

SEQ ID NO: 19775 - RNA, 1647 nt, Artificial Sequence
  derived and/or modified sequence opt3 from major_capsid_protein__Norovirus__AGD79477
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugauugccaugcuguacacuccccucagagcaaauaacucuggagaugacguuuucacagugucguguagggucuuaacucggccuucaccagauuuuagcuucaauuuucuggugcccccgaccguggagaguaagacaaaaccuuucucccuucccaucuugaccauaucugaaaugagcaacucccgcuuuccagucccuauugacucacugcauaccagucccacagagaauaucguugugcagugccagaacgguagaguaacccuagauggcgagcucauggggacgacucaacugcuuccaagccagauuugugcuuucaggggagugcugacccggucuacaucccgcgccucagaccaggcugauacugccacaccccgauuguucaauuauuacuggcacauccagcucgacaaccugaauggcaccccuuaugacccagcagaagauaucccgggucccuuagggaccccugacuuuagaggaaaggucuucggcguggccagccaaaggaacccagauacgaguacucgggcucaugaggcgaaaauugacacaaccucuggccguuuuacucccaagcuggggucccucgaaauaagcacagagucggaugacuucgaucagaauaagccuacccgcuuuacgccaguuggaaucgguguggaccacgaaaccgauuuccagcaauggacacuucccgacuacgcaggccagcugacucacaacaugaauuuggccccggcugucgccccuaacuuuccaggggagcagcuacuguucuuuagaucucagcuccccuccucaggaggcaggaguaaugguauucuggauugccuugugccucaagaguggguacagcauuucuaccaggaaagcgcacccucccagucucaaguugcccuggugcgguauaucaacccagacaccgggcgagucuuguuugaggcuaaacuccacaagcugggcuucaugacaauagccaaaaacggagacagcccuauuacugugcccccaaauggcuacuuucgcuucgaaucaugggucaacccguucuauaccuuagcaccuauggggacaggaaaugguagaaggcggauccaguga

SEQ ID NO: 19776 - RNA, 1647 nt, Artificial Sequence
  derived and/or modified sequence opt3 from major_capsid_protein__Norovirus__AGD79478
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugauugccaugcuguacacuccccucagagcaaauaacucuggagaugacguuuucacagugucguguagggucuuaacucggccuucaccagauuuuagcuucaauuuucuggugcccccgaccguggagaguaagacaaaaccuuucucccuucccaucuugaccauaucugaaaugagcaacucccgcuuuccagucccuauugacucacugcauaccagucccacagagaauaucguugugcagugccagaacgguagaguaacccuagauggcgagcucauggggacgacucaacugcuuccaagccagauuugugcuuucaggggagugcugacccggucuacaucccgcgccucagaccaggcugauacugccacuccccgauuguucaauuauuacuggcacauccagcucgacaaccugaaugaaacaccuuaugacccagcagagggcaucccgggucccuuagggaccccugauuuuagaggaaaggucuucggcguggccagccaaaggaacccagacacgacuacacgggcucaugaagcgaaaguugauaccaccaguggccguuuuacacccaagcuggggucucucgagauuuccaccgaaagcgacgauuucgaccagaauaagccuacgcgcuuuaccccagugggaauaggugucgaucacgaggcagacuuccagcaauggacacuucccgauuacgccggccaguuuacucacaacaugaaucuggcuccggccguggcaccuaacuucccaggggagcaguugcuauuuuucagaucgcagcugcccucuuccggaggcaggucaaaugguauccucgacugccugguaccucaagaauggguucagcauuuuuaccaggagagugcccccagccagucccaaguggcucuuguccgguauauuaacccagauaccgggcgagugcuguucgaagccaaauugcacaagcucggcuuuaucacaauagcgaaaaacggagacucuccuauuacugugcccccaaauggcuacuuccgcuucgagagcugggucaacccguuuuauacccuggcaccuauggggacaggaaaugguagaaggcggauccaguga

SEQ ID NO: 19777 - RNA, 1647 nt, Artificial Sequence
  derived and/or modified sequence opt3 from major_capsid_protein__Norovirus__AGD79479
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugauugccaugcuguacacuccccucagagcaaauaacucuggagaugacguuuucacagugucguguagggucuuaacucggccuucaccagauuuuagcuucaauuuucuggugcccccgaccguggagaguaagacaaaaccuuucucccuucccaucuugaccauaucugaaaugagcaacucccgcuuuccagucccuauugacucacugcauaccagucccacagagaauaucguugugcagugccagaacgguagaguaacccuagauggcgagcucauggggacgacucaacugcuuccaagccagauuugugcuuucaggggagugcugacccggucuacaucccgcgccucagaccaggcugauacugccacuccccgauuguucaauuauuacuggcacauccagcucgacaaccugaauggcacaccuuaugacccagcagaagauaucccgggucccuuagggaccccugacuuuagaggaaaggucuucggcguggccagccaaaggaacccagauacgacuacacgggcucaugaggcgaaaguugacaccaccaguggccguuuuacacccaagcuggggucucucgaaauuuccaccgagagcgaugacuucgaucagaauaagccuacgcgcuuuaccccagugggaauaggugucgaccacgaagcagauuuccagcaauggacacuucccgacuacgccggccaguuuacucacaacaugaaucuggcuccggccguggcaccuaacuucccaggggagcaguugcuauuuuucagaucgcagcugcccucuuccggaggcaggaccaaugguauccucgauugccugguaccucaagaguggguucagcauuuuuaccaggaaucagcccccagucagagccaaguggcucuuguccgguauauuaacccagacacagggcgagugcuguucgaggccaaauugcacaagcucggcuuuaucacuauagcgaaaaacggagacuccccuauuaccgugcccccaaauggcuacuuccgcuucgaaucuugggucaacccguuuuauacacuggcaccuauggggaccggaaaugguagaaggcggauccaguga

SEQ ID NO: 19778 - RNA, 1620 nt, Artificial Sequence
  derived and/or modified sequence opt3 from major_capsid_protein__Norovirus__AGH24750
augaagauggccagcaacgacaccauccccuccgauggcucuacagcuaaucuggugccugaggucaacaaugaaguuauggcacucgagccagugguaggggccgcgauugcugccccgguggcaggacagcaaaacgucauagaccccuggaucagaaauaacuucgugcaggccccugguggcgaauuuacuguuucaccaaggaaugcucccggggagauucuuuggaguaugccucugagcccagauuugaaccccuacuuaucccaccugucucggauguauaauggauacgcaggcgguuucgaagugcaggucauccuagccgggaacgcuuuuacggccggaaaaauuaucuucgcggcaauaccuccaaauuuuccgaccgacggccucucgcccucacaggugacaauguucccucauaucauuguagauguucgccaacuggagccagugcuuaucccccugccugacguccgaaacaauuuuuaucacuacaaccaggugaaugauagcacuuugaagcucauugccaugcuguauaccccacugcgugcuaacaacgccggcgacgauguguucacagucaguugcagaguucucaccaggcccuccccggacuuugauuucaucuuuuuagugccucccacuguagagucucggacaaaaccauucaccgugccuauacugacggucgacgaaaugacuaauagccgcuuucccaccccacuugagagauugcauacagggcccaacaauucccuggugguucagccucagaacggaagguguacuauugauggugugcuacucggcaccacacaacugucagcagucaauaucugcaguuuccgcggggacagcaccacgcgggaaggacagucucacgcuuacacuaugaaccuugccucccagaauuggacaaacuaugacccaaccgaggauauuccggcgccccugggcacuccugacuucguggguaagaucguagggauguugucacagacaacccgagagaauagcaguacgagagcccauaaagcaaccguuucuacaggagaugcucacuuuaugccaaagcucggcuccgugcuguucacuaccgacacagaagauuuacaaaacggccagaauacuagguuuacccccgucgggguggcccaggacggagagccucaccaaaacgaaccacagcaguggcggcugcccaauuacagcgguacaccgggccauaacguccaccucgcuccuccaguggcccccaccuucccuggggagcagcuucuguuuuuccguucgacuaugcccggauguggcgguuacccaaauauggauuuggacugccuacugccucaagaauggguucgccauuuuuaucaggaggcagcccccgcucagucugauguggcgcuccugagauucguaaacccagacacggggaggguccuuuuugaguguaagcugcacaaagcaggcuacaucacagugucccacaccggaccguaugauuugguuauuccucccaacggcuacuuccgguuugacucaugggugaaucaguucuaugcccucgcuccaauggggacuggaaccggucgacgcagagcccuguga

SEQ ID NO: 19779 - RNA, 1623 nt, Artificial Sequence; identical to SEQ ID NO: 18202
  derived and/or modified sequence opt3 from major_capsid_protein__Norovirus__AGI37922

SEQ ID NO: 19780 - RNA, 1623 nt, Artificial Sequence
  derived and/or modified sequence opt3 from major_capsid_protein__Norovirus__AGM46344
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccaucuuaacagucgaggaaaugaccaacucucgcuuuccaauaccccuggagaaacuuuucacgggaccuagcuccgcguucgugguucagccacagaaugguagauguacuaccgauggcguguugcuggggacaacucaacuaucaccggucaacauuugcaccuuuaggggagacgugacacauaucaccggcagucggaauuacacgaugaaccucgccacucagaauuggaacagcuaugaucccacagaggaaauuccugcaccacuggguacccccgacuucguagggaagauccagggaguucuuacucagacaacccgcgcugacggcucuacgcgaggccacaaggccaccguguacacaggguccgcugauuuugccccuaagcugggaagaguccaauucgcaacugacaccgauaaugacuuugaugccaaccagaauacaaaauucacuccagugggugucauccaggacggcgauaccgcucauaggaacgagccccaacaguggguguugccgucauacagcgggcggaauagucacaacguucaccucgcgccugcaguggccccaacauuucccggagaacagcuguuauucuuucguucuaccaugccuggcuguuccgguuaucccaauauggaccuggauugccuccuuccacaggaguggguacaauacuucuaucaggaagcugccccugcacagagcgacgucgcccuguugcgcuuugugaaccccgauacugggagaguucuauucgaguguaagcugcauaaaucgggcuacgugacggucgcucacacaggacagcaugaccucgugauuccaccgaacggcuauuuuagguucgacucuuggguaaaucaauucuacacccuggccccuauggggaacggaacuggucggcgacgcgcacuuuga

SEQ ID NO: 19781 - RNA, 1623 nt, Artificial Sequence
  derived and/or modified sequence opt3 from major_capsid_protein__Norovirus__AGM46347
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuuagcccuaagcugggaagaguccaauucgccacugacaccgauaaugacuuugaugcaaaucagaacacaaaauucacuccagugggugucauccaggacggcgauaccgcccauaggaaugagccccaacaguggguguugccgaguuacucugggcggaacucccacaauguucaccucgcuccugcgguggcaccaacauuucccggagaacagcuguuauucuuucguagcaccaugccuggcuguucggguuaucccaacauggaccuggauugccuccuuccacaggaguggguacaauacuucuaucaggaagccgcuccugcccagucugacgucgcacuguugcgcuuugugaaucccgauacugggagaguucuauucgaguguaagcugcauaaauccggcuacgugacggucgcccacacaggacagcaugaccucgugauuccaccgaacggcuauuuuagguucgacucauggguaaaccaauucuacacccuggcuccuauggggaauggaacuggucggcgacgcgcccuuuga

SEQ ID NO: 19782 - RNA, 1623 nt, Artificial Sequence; identical to SEQ ID NO: 17702
  derived and/or modified sequence opt3 from major_capsid_protein__Norovirus__AGM46349

SEQ ID NO: 19783 - RNA, 1623 nt, Artificial Sequence; identical to SEQ ID NO: 17702
  derived and/or modified sequence opt3 from major_capsid_protein__Norovirus__AGM46355

SEQ ID NO: 19784 - RNA, 1623 nt, Artificial Sequence
  derived and/or modified sequence opt3 from major_capsid_protein__Norovirus__AGM46359
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaacucucgcuuuccaaucccccuggagaaacuuuucacgggaccuagcuccgcguucguugugcagccacagaaugguagauguacuaccgauggcgucuugcuggggacaacucaacuaucaccggugaacauaugcaccuuuaggggagacguaacacauauuaguagcucucggaauuacaccaugaaccucgccucccagaauuggucaagcuaugaucccacggaggaaaucccugcaccacugggcacucccgacuucguugguaagauucagggggugcuuacacagaccacucgcacagacggaaguacccgaggccacaaggcuacggucuacaccggcucugccgauuuuuccccuaagcuggggagagugcaauucgacacagauacugacaacgauuuugagaccaaucagaacacaaaauucacuccagucggagugauccaggacgguagcaccacauacaggaaugaaccccaacaguggguuuugccgucguauucuggccggaacacccauaaugugcaccucgcuccugccguagcaccaacuuuucccggggagcagcuguuauucuuucguuccacgaugccuggauguucaggcuaccccaacauggaucuggacugccuccuuccacaggaauggguccaauauuucuaccaggaggccgcuccugcgcagagugauguggcacuguugcgcuuuguuaaucccgacacagguagagugcuauucgaguguaagcugcacaaaagcggguaugucaccguggcccauacuggccagcacgaucucguaaucccaccgaacggauacuuuagguucgacuccugggugaaccaauucuauacccuggcuccuaugggcaaugggacaggacggcgacgcgcccuuuga

SEQ ID NO: 19785 - RNA, 1623 nt, Artificial Sequence
  derived and/or modified sequence opt3 from major_capsid_protein__Norovirus__AGM46362
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuucuagcucccggaacuacaccaugaaucucgccucacagaacuggagcaguuaugaucccacggaggaaaucccugcaccacugggcacucccgacuucguugguaagauucagggggugcuuacacagaccacucgcacagacggaucuacccgaggccacaaggcuacggucuacaccggcuccgccgauuuuagcccuaagcuggggagagugcaauucgacacagauacugacaaugauuuugagaccaaccagaauacaaaauucacuccagucggagugauccaggacgguucgaccacauacaggaacgaaccccaacaguggguuuugccgucuuauuccggccggaauacccauaacgugcaccucgcuccugccguagcaccaacuuuucccggggagcagcuguuauucuuucguucaacgaugccuggauguaguggcuaccccaauauggaucuggacugccuccuuccacaggaauggguccaauauuucuaccaggaggccgcuccugcgcagagcgauguggcacuguugcgcuuuguuaaccccgacacagguagagugcuauucgaguguaagcugcacaaauccggguaugucaccguggcccauacuggccagcacgaucucguaaucccaccgaauggauacuuuagguucgacucuugggugaaccaauucuauacccuggcuccuaugggcaacgggacaggacggcgacgcgcccuuuga

SEQ ID NO: 19786 - RNA, 1623 nt, Artificial Sequence
  derived and/or modified sequence opt3 from major_capsid_protein__Norovirus__AGM46366
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaucaggcuacgucacaguggcucauaccggacagcacgaucucguaauuccucccaacggcuauuuuagguucgacaguugggugaaucaauucuacacucuggccccaauggggaacggaaccgguagccggcgagcacuuuga

SEQ ID NO: 19787 - RNA, 1623 nt, Artificial Sequence; identical to SEQ ID NO: 17702
  derived and/or modified sequence opt3 from major_capsid_protein__Norovirus__AGM46367

SEQ ID NO: 19788 - RNA, 1623 nt, Artificial Sequence
  derived and/or modified sequence opt3 from major_capsid_protein__Norovirus__AGM46370
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucgugcuagcgggaaacgcauuuacugccggcaaaauuaucuucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccauuuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuaccggcagccggaacuacacgaugaaucucgccacucagaacuggaacucuuaugaucccacagaggaaaucccugcaccacuggguacccccgacuucguugggaagauucagggagugcuuacucagacaacccgcgcugacggcuccacgcgaggccacaaggccaccgucuacacagggucagcugauuuugccccuaagcugggaagagugcaauucgcaacugacaccgauaaugacuuugaugccaaucagaacacaaaauucacuccagucggugugauccaggacggcgauaccgcucauaggaaugagccccaacaguggguuuugccgagcuacagugggcggaacucucacaaugugcaccucgcgccugcaguagccccaacauuucccggagaacagcuguuauucuuucguuccaccaugccuggcuguagcgguuaucccaacauggaccuggauugccuccuuccacaggaguggguccaauacuucuaucaggaagcugccccugcacagucggacguggcccuguugcgcuuuguuaaucccgauacugggagagugcuauucgaguguaagcugcauaaaucuggcuacgucacgguggcucacacaggacagcaugaccucguaaucccaccgaacggcuauuuuagguucgacuccugggugaaccaauucuacacccuggccccuauggggaauggaacuggucggcgacgcgcacuuuga

SEQ ID NO: 19789 - RNA, 1623 nt, Artificial Sequence; identical to SEQ ID NO: 19788
  derived and/or modified sequence opt3 from major_capsid_protein__Norovirus__AGM46375

SEQ ID NO: 19790 - RNA, 1623 nt, Artificial Sequence
  derived and/or modified sequence opt3 from major_capsid_protein__Norovirus__AGM46377
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccaucuuaacugucgaggaaaugacaaauagccgcuuuccaauaccccuggagaaacuuuucaccggaccuuccucagccuucgugguucagccacagaacgguagauguacgacugauggcguguugcuggggaccacacaacuaaguccggucaauauuugcacuuuuaggggagacgugacccauaucacaggcagccggaacuacaccaugaaucucgcaacgcagaacuggaacucuuaugaucccacugaggaaauuccugcuccacuggguacacccgacuucguagggaagauccagggaguucuuacccagacuacacgcgccgacggcuccacccgaggccacaaggcuacgguguacaccgggucagccgauuuugcaccuaagcugggaagaguccaauucgccacagacacugauaaugacuuugaugcuaaucagaacaccaaauucacaccagugggugucauccaggacggcgauacugcgcauaggaaugagccccaacaguggguguugccgagcuacagugggcggaacucucacaauguucaccucgccccugcaguggcuccaaccuuucccggagaacagcuguuauucuuucguuccacaaugccuggcuguagcgguuaucccaacauggaccuggauugccuccuuccacaggaguggguacaauacuucuaucaggaagccgccccugcacagucggacgucgcucuguugcgcuuugugaaucccgauaccgggagaguucuauucgaguguaagcugcauaaaucuggcuacgugacugucgcccacacgggacagcaugaccucgugauuccaccgaacggcuauuuuagguucgacuccuggguaaaccaauucuacacacuggcaccuauggggaauggaaccggucggcgacgcgcgcuuuga

SEQ ID NO: 19791 - RNA, 1623 nt, Artificial Sequence; identical to SEQ ID NO: 19788
  derived and/or modified sequence opt3 from major_capsid_protein__Norovirus__AGM46379

SEQ ID NO: 19792 - RNA, 1623 nt, Artificial Sequence; identical to SEQ ID NO: 19788
  derived and/or modified sequence opt3 from major_capsid_protein__Norovirus__AGM46384

SEQ ID NO: 19793 - RNA, 1623 nt, Artificial Sequence
  derived and/or modified sequence opt3 from major_capsid_protein__Norovirus__AGM46386
augaagaugggcagcaacgacgccaaucccuccgaugggucuaccgcuaaccuggugccugaggucaauaacgaaguuauggcacucgagccagugguaggagccgcgaucgcugccccgguggcaggucagcaaaaugucauugaccccuggauaagaaacaauuucgugcaggccccuggcggggaauuuacaguuucaccaaggaacgcucccggagagauccuuuggagugcaccucugggcccagauuugaaucccuacuuaagccaccuggcccggauguauaacgguuacgcugggggauucgaagugcaggucauucuagccggcaaugcguuuacugcaggcaaaaucauuuucgccgcugugccuccaaacuuuccgacggaggggcucucccccucucagguaaccauguucccucauaucauaguugacgugcgccaacuggagccaguccuuaucccccugccugaugugcgaaauaacuuuuaucacuacaaucagucgaacgacccaacaauuaaguugaucgccaugcucuauacuccccugcgugcaaacaaugcuggagaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaacucucgcuuuccaaucccccuggagaaacuuuucacggguccuagcuccgccuucguugugcagccacagaauggcagauguacuaccgauggggucuugcugggaacaacucaacuaucaccggugaacauaugcaccuuuaggggcgacguaacacauauucccgguagucggaauuacaccaugaaccucgcgagccagaauuggaacucuuaugauccuacggaggaaaucccagcaccccuggggacuccugacuucguuggaaagauucagggcgugcuuacacagaccacucgcacaaauggcuccacccgagggcacaaggccacggucuacaccggaucagcugacuuuagcccaaagcuggguagagugcaauucgccacagauacugacaacgauuuugagaccaaucagaacacaaaauucacucccgucggcgugauccaggacgggaguaccacaccgaggaaugaaccucaacaguggguuuugccaucuuacuccggacggaacauccauaaugugcaccucgcucccgccguagcaccuaccuuucccggcgagcagcuguuauucuuucguagcacuaugccagguuguucgggguauccuaacauggaucuggacugccuccuuccccaggaauggguccaauacuucuaucaggaggccgcuccagcgcagucugauguggcacuguugcgcuuuguuaacccggacacgggcagagugcuauucgaguguaagcugcacaaauccggauacgucacaguggcccauaccggccagcacgaucucguaauuccucccaauggguauuuuagguucgacucaugggugaaccaauucuacacucuggcuccaaugggaaaugguaccggccggcgacgcgcccuuuga

SEQ ID NO: 19794 - RNA, 1623 nt, Artificial Sequence
  derived and/or modified sequence opt3 from major_capsid_protein__Norovirus__AGM46388
augaagaugggcagcaacgacgccaaucccuccgaugggucuaccgcuaaccuggugccugaggucaauaacgaaguuauggcacucgagccagugguaggagccgcgaucgcugccccgguggcaggucagcaaaaugucauugaccccuggauaagaaacaauuucgugcaggccccuggcggggaauuuacaguuucaccaaggaacgcucccggagagauccuuuggagugcaccucugggcccagauuugaaucccuacuuaagccaccuggcccggauguauaacgguuacgcugggggauucgaagugcaggucauucuagccggcaaugcguuuacugcaggcaaaaucauuuucgccgcugugccuccaaacuuuccgacggaggggcucucccccucucagguaaccauguucccucauaucauaguugacgugcgccaacuggagccaguccuuaucccccugccugaugugcgaaauaacuuuuaucacuacaaucagucgaacgacccaacaauuaaguugaucgccaugcucuauacuccccugcgugcaaacaaugcuggagaugacguguucaccgucucaugcagaguucugacaaggccgagcccugauuuugacuucauuuuucucgugcccccaaccguagaaagucggacuaaaccuuucuccgugcccaucuuaacagucgaggaaaugaccaacucucgcuuuccaauaccccuggagaaacuuuucacggguccuagcuccgccuucgugguucagccacagaauggcagauguacuaccgaugggguguugcugggaacaacucaacuaucaccggucaacauuugcaccuuuaggggcgacgugacacauaucaccgguagucggaauuacacgaugaaccucgcgacucagaauuggaacagcuaugaucccacagaggaaauuccugccccacuggggacccccgacuucguaggaaagauccagggcguucuuacucagacaacccgcgcagacggcucuacgcgagggcacaaggcuaccguguacacaggauccgccgauuuugcuccuaagcuggguagaguccaauucgccacugacaccgauaaugacuuugaugcaaaccagaauacaaaauucacuccagugggcgucauccaggacggggauaccgcccauaggaacgagccccaacaguggguguugccgucauacagcggacggaauagucacaacguucaccucgcuccugcgguggcaccaacauuucccggcgaacagcuguuauucuuucguucuaccaugccugguuguuccggguaucccaauauggaccuggauugccuccuuccacaggaguggguacaauacuucuaucaggaagccgcuccugcccagagcgacgucgcacuguugcgcuuugugaaccccgauacuggcagaguucuauucgaguguaagcugcauaaaucgggauacgugacggucgcccacacaggccagcaugaccucgugauuccaccgaacggguauuuuagguucgacucuuggguaaaucaauucuacacccuggcuccuaugggaaacgguacuggccggcgacgcgcccuuuga

SEQ ID NO: 19795 - RNA, 1623 nt, Artificial Sequence
  derived and/or modified sequence opt3 from major_capsid_protein__Norovirus__AGM46392
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuauugauggcguguugcuggggaccacacaacuaaguccggucaauaucugcacuuuuaggggagacgugacccauauuacaggcagccggaacuacaccaugaaucucgccacgcagaacuggaacucuuaugaucccacugaggaaaucccugcaccacuggguacacccgacuucguagggaagauccagggaguucuuacccagacuacacgcgcugacggcuccacccgaggccacaaggccacgguguacaccgggucagcugauuuugccccuaagcugggaagaguccaauucgcaacagacacugauaaugacuuugaugccaaucagaacaccaaauucacaccagugggugucauucaggacggcaauacugcucauaggaacgagccccaacaguggguguugccgagcuacagugggcguaauucucacaacguucaccucgcgccugcaguggccccaaccuuucccggagaacaguuccuguuuuuccgguccacaaugccuggcuguagcgguuaucccaauauggauuuagacugccugcucccacaggaguggguacaauacuuuuaucaggaagcugccccugcacagucggaugucgcccuucugcgcuucgugaaccccgacaccgggagaguuuuguuugaguguaagcuacauaaaucuggcuacgugacugucgcucacacgggacagcaugaucuggugauaccaccgaacggcuauuucagguucgacuccuggguaaaucaauuuuacacacucgccccuauggggaacggaaccggucggcgacgcgcacuguga

SEQ ID NO: 19796 - RNA, 1623 nt, Artificial Sequence; identical to SEQ ID NO: 18202
  derived and/or modified sequence opt3 from major_capsid_protein__Norovirus__AGM46395

SEQ ID NO: 19797 - RNA, 1623 nt, Artificial Sequence
  derived and/or modified sequence opt3 from major_capsid_protein__Norovirus__AGM46398
augaagauggccagcuccgacgcuaaccccucugauggcucaaaagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuaccguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacagccggcaagaucauuuucgcugccgugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaauugaucgcaaugcucuauacaccccugcgugcuaacaacgccggggaugacguguucacugucagcugcagaguucugaccaggccgaguccugauuuugacuucauuuuucucgugcccccaacaguagaaucccggaccaagccuuucucugugcccgucuuaacuguggaggaaaugacaaauagccgcuuuccaaucccccuggagaaacuuuucaccggaccuuccucagcguucguugugcagccacagaacgguagauguacgacugauggcgucuugcuggggaccacacaacuaaguccggugaauauaugcacuuuuaggggagacguaacccauauucccggcagccggaacuacacaaugaaucucgccucucagaacuggaacuccuaugauccuaccgaggaaaucccagcaccccuggguacgccugacuucguugggaagauucagggagugcuuacucagacaacccgcacuaauggcucaacacgaggccacaaggcuaccgucuacacggggagcgccgacuuuaguccaaaacugggaagagugcaauucgcuaccgauacagacaaugauuuugagacuaaccagaauaccaaguucacacccgucggugugauccaggacggcucuacuaccccgaggaacgaaccucaacaguggguuuugccauccuacagcgggcggaauauccauaacgugcaccucgcccccgcaguagccccuacauuucccggagagcagcuguuauucuuucguucgaccaugccaggcuguucugguuauccuaauauggaucuggacugccuccuuccccaggaauggguccaauacuucuaucaggaggcugcgccagcacaguccgauguggcccuguugcgcuuuguuaacccggacacugggagagugcuauucgaguguaaacugcacaagucaggcuacgucacgguggcucauacaggacagcacgaucucguaauuccucccaacggcuauuuuagguucgacaguugggugaaucaauucuacacccuggccccaauggggaacggaacugguagccggcgagcacuuuga

SEQ ID NO: 19798 - RNA, 1623 nt, Artificial Sequence; identical to SEQ ID NO: 17702
  derived and/or modified sequence opt3 from major_capsid_protein__Norovirus__AGM46401

SEQ ID NO: 19799 - RNA, 1623 nt, Artificial Sequence; identical to SEQ ID NO: 17702
  derived and/or modified sequence opt3 from major_capsid_protein__Norovirus__AGM46403

SEQ ID NO: 19800 - RNA, 1623 nt, Artificial Sequence
  derived and/or modified sequence opt3 from major_capsid_protein__Norovirus__AGM46407
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccucccugggaccugauuugaacccauacuuaucucaccuggcucggauguauaauggcuacgccgguggguucgaagugcaggucauucuagcgggaaacgcauuuacugccggcaaaaucauuuucgcugccgugcccccuaauuuuccaacggagggccucucgccgucacagguaaccauguucccccauaucauaguugacgugcgccaacuggagccuguccuuaucccacugcccgaugugcgaaacaauuuuuaucacuacaaccagagcaaugacccuacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaauuccgccuaacggcuauuuuagguucgacagcugggugaaucaauucuacacucuggcccccauggggaacggaaccggucggcgacgcgcacuuuga

SEQ ID NO: 19801 - RNA, 1623 nt, Artificial Sequence
  derived and/or modified sequence opt3 from major_capsid_protein__Norovirus__AGM46409
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcuccgcguucgugguucagccucagaaugguagauguaccacagacggcguguugcuggggacuacccaacuaucaccagucaacauuugcacauuuaggggagaugugacccauaucgccggcagucggaauuacacgaugaaccucgcaagccugaauuggaacaauuaugacccgacugaagagauucccgcuccucuugguacaccagauuucguagggaagauccagggaguucugacccagacuacaaagggcgacggcucuacccgcgggcacaaggccacgguguacaccggauccgcucccuuuacaccuaaauuggguucaguccaguucagcacugacaccgaaaacgauuuugagacacaucaaaauacuaaguucaccccagugggcgucauccaggacgggggaacaacccaccgaaacgaaccccagcaaugggugcucccgaguuacucuggcagaaauguucagaacgugcaccuggccccugcaguagccccaacuuuucccggugagcaguuacuguucuuuagguccacgaugccuggguguagcggcuaucccaauauggaucucgacugccuucugccacaggaguggguccaacauuucuaccaggaagcugcgccugcacagucggauguggccuugcuacgguuuguuaaccccgacacaggacgugugcuguucgaguguaaacuccacaagucuggcuaugucaccguggcucauacugggcagcacgaucugguaauuccaccgaacggauacuuucgcuucgacuccugggugaaucaauucuauacccuugccccuauggguaacggcacagggagaaggcgggcacuguga

SEQ ID NO: 19802 - RNA, 1623 nt, Artificial Sequence; identical to SEQ ID NO: 18822
  derived and/or modified sequence opt3 from major_capsid_protein__Norovirus__AGM46413

SEQ ID NO: 19803 - RNA, 1623 nt, Artificial Sequence
  derived and/or modified sequence opt3 from major_capsid_protein__Norovirus__AGM46415
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccacaacuacaccaugaaucucgcuucucugaacuggaauaacuaugacccgacggaagagauucccgccccucuugguacuccagauuucguagggaagauccagggaguucugacacagaccacuaagggcgacggcuccacacgggggcauaaggcuaccguguacacgggaucagcccccuuuaccccuaaauuggguagcguccaguucaguacagacacugaaaaugauuuugagacccaccaaaacacaaaguucacuccagugggcgucauccaggacgggggaaccacacaccgcaaugaaccccagcaaugggugcucccgucuuacuccggccgaaacguuccuaaugugcaucuggcaccagccguagcucccaccuuuccuggugagcaguuacuguucuuuagaagcacuaugcccggguguucgggcuauccaaacauggaucucgacugccuucugccucaggaguggguccagcacuucuaccaagaagcggcacccgcccagucugauguggcuuugcuaagguuuguuaauccagacacgggacgggugcuguucgaguguaaacuccauaaguccggcuaugucacaguggcccacaccgggcagcacgaucugguaauuccgccuaacggauacuuucguuucgacucaugggugaaccaguucuauacucuugcacccauggguaauggcaccgggcgcagaagggcccuguga

SEQ ID NO: 19804 - RNA, 1623 nt, Artificial Sequence
  derived and/or modified sequence opt3 from major_capsid_protein__Norovirus__AGM46419
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggaucccagauuucguaggaaagauccagggcguucugacucagacaaccaagggcgacgggucuacucgcggacacaaggcuacaguguacaccgguuccgcccccuuuacgccuaaauugggcucaguccaguucagcaccgacacagaaaaugauuuugagacucaucaaaacaccaaguucacaccagugggggucauucaggacggaggcacuacccaccgaaaugaaccccagcaaugggugcucccgaguuacucugguagaaacguucagaaugugcaccuggccccugcaguagcuccaacauuucccggggagcaguuacuguucuuuagguccaccaugccuggcuguagcggauaucccaacauggaucucgacugccuucugccacaggaguggguccaacauuucuaccaggaagcggccccugcacagucggauguggcuuugcuacgguuuguuaaucccgacacuggccgugugcuguucgaguguaaacuccacaagucuggguaugucacgguggcccauacaggacagcacgaucugguaauaccaccgaacgguuacuuucgcuucgacuccugggugaaccaauucuauacccuugcaccuaugggcaaugggacuggaagaaggcgggcccuguga

SEQ ID NO: 19805 - RNA, 1623 nt, Artificial Sequence
  derived and/or modified sequence opt3 from major_capsid_protein__Norovirus__AGM46421
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccgggacuacaccaugaaccucgcuucucugaauuggaacaauuaugauccgacggaagagauucccgccccucuugguacuccagacuucguagggaagauccagggaguucugacacagaccacuaagggcgacggcuccacacgcgggcacaaggcuaccguguacacgggaucaacccccuuuacaccuaaauuggguagcguccaguucaguacugauaccgaaaacgacuuugagacacaucaaaauacuaaguucaccccagugggcgucauccaggaugggggaacaacccaccgaaacgaaccccagcaaugggugcucccgucuuacuccggcagaaauguucagaacgugcaccuggccccugcaguagccccaacuuuucccggugagcaguuacuguucuuuaggagcacgaugccuggguguucgggcuaucccaauauggaccucgauugccuucugccacaggaguggguccaacauuucuaccaggaagcugcgccugcacagucugacguggccuugcuacgguuuguuaaccccgauacaggacgugugcuguucgaguguaaacuccacaaguccggcuaugucaccguggcucauacugggcagcacgaccugguaauuccaccgaauggauacuuucgcuucgauucaugggugaaccaauucuauacccuugccccuauggguaacggcacagggagaaggcgggcacuguga

SEQ ID NO: 19806 - RNA, 1623 nt, Artificial Sequence
  derived and/or modified sequence opt3 from major_capsid_protein__Norovirus__AGM46425
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggguauacaccaugaaccucgcuucucugaauuggaacaauuaugacccgacggaagagauucccgccccucuugguacuccagauuucguugggaagauccagggagugcugacacagaccacuaaggaagacggcuccacacgcggccacaaggcuaccgucuacacggggucagcccccuuuaccccuaaauugggaagcgugcaguucaguacagacacugagaacgauuuugaaacccaucaaaauacaaaguucacuccagucggugugauccaggacggcgggaccacacaccgaaacgagccccagcaauggguucucccgucuuacuccggaagaaaugcaccuaacgugcaccuggccccagcuguagcgcccaccuuuccuggcgagcaguuacuguucuuuaggagcacuaugcccgguuguucgggguauccaaauauggaucucgacugccuucugccucaggaauggguccagcauuucuaccaagaggcagcccccgcucagucugauguggccuugcuacgguuuguuaacccagacacgggccgugugcuguucgaauguaaacuccacaaguccggauaugucacaguggcacauaccggccagcacgaucugguaauuccgccuaauggguacuuucgcuucgacucaugggugaaccaguucuauacucuugcccccaugggaaacgguaccggcagaaggcgggcucuguga

SEQ ID NO: 19807 - RNA, 1623 nt, Artificial Sequence
  derived and/or modified sequence opt3 from major_capsid_protein__Norovirus__AGM46427
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaccaccggucaauauuugcaccuuuaggggagaugugacacauaucgcaggcagucggguauacaccaugaaccucgcuagccugaauuggaacaauuaugaccccacggaagagauuccugccccacuugguacucccgauuucguugggaagauccagggagugcugacacagaccacuaaggaagacggcucuacacgcggccacaaggcuaccgucuacacgggguccgccccuuuuaccccaaaauugggaucagugcaguucagcacagacacugagaacgauuuugaaacccaucaaaauacaaaguucacucccgucggugugauccaggacggcgggaccacacaccgaaacgagccgcagcaauggguucucccuaguuacucuggaagaaaugcaccaaacgugcaccuggcccccgcuguagcgccuaccuuucccggcgagcaguuacuguucuuuagguccacuaugccagguuguagcggguauccuaauauggaucucgacugccuucugccccaggaauggguccagcauuucuaccaagaggcagccccagcucagucggauguggccuugcuacgguuuguuaacccggacacgggccgugugcuguucgaauguaaacuccacaagucuggauaugucacaguggcacauaccggccagcacgaucugguaauuccucccaauggguacuuucgcuucgacuccugggugaaccaguucuauacucuugccccaaugggaaacgguaccggcagaaggcgggcucuguga

SEQ ID NO: 19808 - RNA, 1623 nt, Artificial Sequence; identical to SEQ ID NO: 18926
  derived and/or modified sequence opt3 from major_capsid_protein__Norovirus__AGM46431

SEQ ID NO: 19809 - RNA, 1671 nt, Artificial Sequence
  derived and/or modified sequence opt3 from major_capsid_protein__Norovirus__AGN11430
augaagauggccagcuccgacgcugcacccucuaccgauggcgccgggaaccuggugccugagucacagcaagaaguccucccacuugcgccgguugcuggagccgcacuggccgcucccgugguaggucagacaaauaucauugacccuuggauaaaagagaacuucgugcaggcaccacagggcgaauuuacugucagucccaagaauagcccuggggagaucuuggugaacuuagaacugggaccaaaacuaaaucccuaccucgaucaccuguccagaauguauaacucuuacgccggcgguauugacguuauggugguccuugcugggaaugccuucacggcgggaaaggugcugaucgcagccauuccuccaaacuuuccgguagagguugugucggcuucacaagccacccaguucccccaugucaucauagaugugaggacauuggacccugugcggcucccacugcccgauguccgcagcaccuuuuuccacuauacuaaugacacagagccuaaaaugcgacugguuaucuggcucuacaccccauuacguacuaacggcaguggcgaugacuccuuuacagugucugggaggauucugaccagacccagccaggauuucgaauuugcauuccuuaucccgccuacgguagagacuaagaccacacccuuuuccgugccaggauucucaguccaggaaaugaguaauagccgguggccugcugccauuucugcgauggugguucgcgguaacgagccccaagugguccaguuucagaauggcagagcccauuuggacgggaugcugcuaggaacuaccccagugucccccaacuauaucgcaucauacaggggcauaagcacagguaauagucggucugcuuccccugaggccgaugaacgcgcuguagggagcuucgacguuugggugcgacuccaggagccagacggacaaccguaugauauuuucggcaagcagcccgccccuaucggcaccccagacuuuaaagcagucauugugggguucgccgcuagaccccugacgucgggaucuuacgcgaacgaagcauacgucaacacuacagccuccaauuaugcuccugccaccgguaacaugagguuuacugugcggaauggcgggacaggacacaccucagcaaacaaguacugggaguucaaaaguuuuggcguugaaggugagcgucauacggggauccaguaucaagaguacgaacuuccagauuauagcggccagguggccuccaaucacaaccuggcucccccgguagccccucgcaugccaggagagucuuugcuccuguuccagagcaauaugcccgucugggacgauggccacggggaaucaaccccuaagaaaauccauugcuuacugccccaggaguuuauuggacacuucuuugacaagcaagcaccaagucucggugaugcggcccuucugagauacgugaaccaggaaacaaauaggguuuuguucgaguguaagcuauaucgggacggcuacauaacuguggcugcauccagcgggcugcucgauuuuccucuggacggauucuuucgauucgauucuugggucucaaguuucuacauccuuagccccgugggcuccggucaggggcgcagaggcaggguacgguuucaguga

SEQ ID NO: 19810 - RNA, 1647 nt, Artificial Sequence
  derived and/or modified sequence opt3 from major_capsid_protein__Norovirus__AGO64038
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcaggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgaucccaagcuccgacugauugcgaugcuguacacaccucuccgugccaauaacuccggagacgauguuuucacugugucuuguagagucuuaaccaggccaucgcccgacuuuucauucaauuuucuggugccgccuacaguggaaagcaaaaccaagcccuucacucuuccaaucuugacaauaagugagauguccaacucucgguuuccuguccccauugauagccugcauaccuccccaacggaaaauaucguugugcagugccagaacggucgcguaacucuagacggcgagcucauggggaccacacaacugcuucccucacagauuugugcauucagaggagugcugacuaggaguaccagccggacaucugaucaggcugacaccgccacgccucgcuuguucaauuauuacuggcacauccagcucgacaaccugaauggcacuccauaugauccggcugaggacauccccgguccuuuagggacaccagauuuucgaggaaaagucuucggcguggccucccaaagaaaccccgacucaaccacuagggcacaugaagccaagguugauacaaccgcuggccgguuuacgccuaagcuggggagccucgagauuaguaccgaaucugacgauuucgaccagaaucagccaacacguuuuacucccgugggaauaggugucgauaacgaggcggacuuccaacaguggucccuuccggauuacagcggccaguuuacccacaauaugaaccuggcgccugccguggcuccaaauuuccccggggaacaguugcuauuuuuccgcucgcaacugccuucuuccggaggcagaucaaacgguauccucgacugccugguaccccaggaguggguucagcacuuuuaccaggagagugccccagcacaaacacagguggcccuugucagguaugugaacccugacacugggcggguccuguucgaagcuaaauugcauaagcucggcuuuaugaccauugccaaaaauggagauagccccaucacagugccaccgaacggcuacuuccgauucgaguccuggguuaauccuuuuuauacccuggcacccauggggacuggaaacggucgcagaaggauacaguga

SEQ ID NO: 19811 - RNA, 1623 nt, Artificial Sequence
  derived and/or modified sequence opt3 from major_capsid_protein__Norovirus__AGO64040
augaagauggccagcaacgacgcugcacccuccaaugauggcgccgcggggcuggugccugagaucaacaaugaagucaugccacucgagccgguugcuggagccucucccgcaaccccugugguaggucagcaaaacauuauagacccauggaucagaaauaacuucgugcaggcccccgcuggcgaauuuacagucucaccuaggaauaguccaggggagauucuucuggauuuggaauuaggacccgagcugaacccuuaccuagcacaccucgcccggauguauaauggccaugcuggugggauggaggugcagaucguucuggccggaaacgcguucacugcaggcaaaauuaucuuugccgcuauaccaccgggcuucccccacgaaaaucuuagcccuucccagaucacgaugugcccacaugugauuaucgacguccgccaacuggagcccguguugcucccuaugccagauauucgaaacaacuuuuuccacuacaaucaggggaaugaccccaagcugcgucugaucgccaugcucuauaccccguuaagagcaaacaacucuggagaugacguauuuacaguuucguguagggugcugacuaaaccuucacccgauuucgaauuuaccuuccuugucccaccuacaguggagagcaagaccaaacaguuuacuuugcccauacugaagauuagugagaugacaaauucccgguucccagugcccgucgaaaugauguacaccgcucgcaacgagaaucagguugugcaaccucagaacgguagaguaacgcuagacggcgaacuccuggggacuaccccacuucugggaaucgauauuugcaaguuuaaaggcgaggugaucgccaagaauagggacgaucggucuuaucgcauggacauggaaaucacaaacacugacgguaccccgauugaucccacagaggacaccccugggccaauaggaagccccgauuuccgaggcaucuuguucggcgucgcgucccagagaaauaaaaacgagcagaauccugccacgagggggcaugaagcaaacauuaauacuggagguaaccaauacgcuccaaagcucgcccaggugaaauuuuucucagagagugacgauuuugacgaacaccagcccacaguuuucaccccggugggcgucgcuggggaugacagccacccuuuucggcaaugggugcugccacguuauggaggccauuuaacuaauaacacacaccuggcccccgcaguagccccucucuuccccggugagcagauccuguuuuuccgcucucagauaccauccucagggggcuuugaacuuggauacauggauuguuugguuccucaggagugggugcaacauuucuaccaggaggcugcgaccgcacagagcgacgucgcccuaauuagauuuaucaaucccgauacgggcagggugcuguucgaagcuaagcuccacaagcagggguuuaucaccgucgcccacacaggagacaacccaauugugaugccgccuaacgguuauuuccgguucgaggcauggguuaaucaauuuuacagucuggcccccgugggcacugggaacggacgacgcagaguacaguga

SEQ ID NO: 19812 - RNA, 1608 nt, Artificial Sequence
  derived and/or modified sequence opt3 from major_capsid_protein__Norovirus__AGO64042
augaagauggccagcaacgacgcugcacccuccaaugauggcgccgcggggcuggugccugaggcuaacaaugaaaccauggcccucgagccagucgcaggagccucuaucgcugcaccgcuuacaggucagaacaauguuauugaccccuggauaagacugaacuucgugcaagccccuaauggcgaauuuacuguaucaccaaggaacagucccggggagaucuuguuaaaucuggaacuaggaccugagcucaacccauaccuggcucaccuuagccggauguauaauggcuacgccggugggguggagguccaggugcuguuggcgggaaacgcauucacggccggcaaacucguuuuugcugccgugcccccucauuucccacuggaaaauauuuccccgggccagaucaccauguuuccccacgucauuaucgaugugcgcacacuggagccuguacucuuaccacugcccgacguucgaaacucuuucuuucauuauaaucagcaaaacgaaccucguaugagacuuguggcaauguuguacacuccacugaggucgaacgggucaggagaugacgucuucaccgugagcugccgggugcuaacacgccccaguccggauuuugacuucaauuaucucgucccucccaccguugaguccaagacuaaaccauuuacacugccuauacuuaccaugggugagcugacgaacucuagauuccccgugccaaucgaugaauuguacacuagccccaaugagaaccucguagugcagccucagaaugggaggugugcucuggacggcgaauuacagggaaccacacaacugcucccaacugccauuugcuccuuucggggccgcgucaaccagaaggugucaggugagaaucacguuuggaacaugcaagugaccaauaucaacgggacaccguucgaucccaccgaagacgucccugcgccacuuggaacgcccgauuucaguggccgacuguuuggcguguugagccagagagaccaugacaaugccuguaggucucacgaugcaguaauugcuacuaacuccacaaaauucaccccuaagcuaggggccauccagauaggaacuugggaggaggacgauguucacauuaaucagccaacaaaguuuacccccgugggucuguucgacacggaugacuuuaaccagugggcucucccgaauuauucaggcgcccugacccuuaacauggggcuggcaccuccagucgcccccacauucccuggagaacaaaucuuguuuuuccggagccauauuccccucaaaggcgguguggcugauccagucaucgacugccuguuaccucaggaguggauccagcaccuguaccaggaaagugcgcccucucaauccgauguggcacuaauucguuuuacuaacccagacaccgggcgcguucucuucgaggccaagcugcauagaagcggcuacauaacaguggcuaauacuggaaacaggccgaucguagucccugccaauggcuauuuucgguucgauucgugggugaaccaguuuuacucucuugcacccauggggaccggaaauggucgacgcagaguucaguga

SEQ ID NO: 19813 - RNA, 1623 nt, Artificial Sequence
  derived and/or modified sequence opt3 from major_capsid_protein__Norovirus__AGS41450
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucgcaacagacacugagaacgauuuugaaacccaucaaaauacaaaguucacuccugugggcgucauccaggacgggagcaccacacaccgaaacgagccacagcaaugggugcuccccaguuacucuggaagaaauguucacaacgugcaucuggccccggcuguagcgccuaauuuuccaggcgaacaguuacuguucuuuagguccaccaugcccgguuguagcggguauccuaacacugaucucgacugccuucugccccaggaguggguccagcacuucuaccaagaggcagccccagcucagucggauguggccuugcuacgguuuguuaacccugacacgggccgugugcuguucgaauguaaacuccauaagucuggauaugucacaguggcacacaccggccagcacgaucugguaauucccccaaauggguacuuucgcuucgacuccugggugaaccaguucuauacucuugccccgaugggaaaugguaccggcagaaggcgggcucuguga

SEQ ID NO: 19814 - RNA, 1623 nt, Artificial Sequence
  derived and/or modified sequence opt3 from major_capsid_protein__Norovirus__AGT62521
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccugugcagggcauguuuaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcacacccuucauuccucuggaaagcccagcuccggugggguuucccgacuuaggagguugugauuggcacguaaauuucaccuuucaggcccaagaccaggauccuagucagucuguuacguucgcuacuaacgacgccuccuuugugccauaucugggcagcaucucgccccauaaugggggagauuuccacgcaggcgacauuaucgguucucucggguggaucuccgccccuucaggcaacagucagcuuaaugucugggcuauuccaaaguacggaagcucccugcccgaugugacacacuuggcgccggcagucuuuccuccaggcuucggggaggugauacuauauuuuuacucuaccuuccccggaagcggucaaccuucacagcugcagguucccugccuccugccacaggaauuuaucacucauuucuguaacgagcaagccccuauugcuggcgaggccgcacuucugcacuauguggaccccgauacagggcgcaauuugggagaauuuaagcucuacccagacggcuucaugaccugcguaccgaacagugucuccagcgguccucagacgcugcccaucaaugggguguucguuuuugugucuugggucucacgauucuaccaguuaaaaccagugggcaccgccagugcugccagaaggcugggacuacggcguauauga

SEQ ID NO: 19815 - RNA, 1629 nt, Artificial Sequence
  derived and/or modified sequence opt3 from major_capsid_protein__Norovirus__AGT62523
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagaacgaacuucguacaagccccuaauggcgaauuuaccgugucaccaaggaacgcucccggggagguccuguugaauuuagaacugggaccugagcuaaacccauaccucgcccaccuggcgcggauguauaauggcuacgccggugggauggaggugcagguuaugcuugcaggaaacgcuuucacagccggcaaacugguguuugcagcugugcccccucauuucccagucgaaaauuugaguccgcagcagaucacuauguuuccccacguaauuaucgauguucgcacccucgagccugugcugcugccacuccccgacguccgaaacaauuucuuucauuauaaccaaaaggaugacccuaaaaugcguauuguggccauguuauacacaccacugagaagcaauggcuccggggaugacguguucaccgucucuugcaggguucuuacucggcccucgccggauuuugacuucacauauuuggugccucccaccguagaaucaaagacgaaaccauuuacucugccuauccuaacccucggagagaugagcaacagucgcuuccccgugccaauagaucagauguacacaucccccaacgaggucaucucugugcagugucagaaugguagaugcacucuggacggcgaacuucaagggaccacacagcugcagguuagcggaauuugugcguuuaagggccaggugaccgcccacuugcaagauaacgagcaucucuauaaugucacgaucacuaaccugaaugguuccccuuucgacccaucagaagacauuccggcacccuuaggggugccugauuucgagggaaggguauuuggcguuaucagucagcgggacaacuacaauagcggcgggcagaaccaaccagcuaaucgcucucacgaugccgugguccccacauacaccgcucaguauacuccuaagcugggacagauacagauugguacauggcaaaccgacgauaucacgguggaccagccagccaaauucacccccgucggccucuccgauacagaccacuuuaaccagugggugguuccgcgauacgcaggggcccuuaaucugaacacuaauuuggcuccuucaguggcgccaguauuccccggagaaagacuacuguuuuucaggagcuauauuccucucaagggcgguuuugggaaccccgcaaucgauugccuggucccacaggaguggauccaacauuucuaccaggaggccgcuccuagucuuucugaaguggcccugguucgguauauuaaucccgacaccggccgugcauuguuugaggccaaacuccaccgcgcuggauucaugacaguguccagcaacacuucggccccagucgugguaccggcaaacggcuacuuuagauucgauucuugggugaaucaguuuuauucccuggcgccuauggggaccggaaacgguaggcggcgaauacaguga

SEQ ID NO: 19816 - RNA, 1623 nt, Artificial Sequence; identical to SEQ ID NO: 19020
  derived and/or modified sequence opt3 from major_capsid_protein__Norovirus__AGV40221

SEQ ID NO: 19817 - RNA, 1623 nt, Artificial Sequence
  derived and/or modified sequence opt3 from major_capsid_protein__Norovirus__AGV76553
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacaccuaauguccaccucgccccagcuguggcgcccaccuuuccuggcgaacagcuguuauucuuucguucuacuaugcccgguuguuccggguauccaaacauggaccuggauugccuccuuccucaggaguggguucaauacuucuaucaggaggcagcccccgcucagagcgacguggcccuguugcgcuuugucaauccagauacgggcagagugcuauucgaauguaagcugcauaaaucgggauacguaacaguggcacacucuggccagcaugaccucguuauuccgccuaacggguauuuuagguucgauuccugggucaaccaauucuacacccuggcccccaugggaaaugguacuggccggcgacgcgcucuuuga

SEQ ID NO: 19818 - RNA, 1623 nt, Artificial Sequence; identical to SEQ ID NO: 18321
  derived and/or modified sequence opt3 from major_capsid_protein__Norovirus__AGV76554

SEQ ID NO: 19819 - RNA, 1623 nt, Artificial Sequence; identical to SEQ ID NO: 18321
  derived and/or modified sequence opt3 from major_capsid_protein__Norovirus__AGV76555

SEQ ID NO: 19820 - RNA, 1623 nt, Artificial Sequence; identical to SEQ ID NO: 18321
  derived and/or modified sequence opt3 from major_capsid_protein__Norovirus__AGV76556

SEQ ID NO: 19821 - RNA, 1623 nt, Artificial Sequence; identical to SEQ ID NO: 18321
  derived and/or modified sequence opt3 from major_capsid_protein__Norovirus__AGV76557

SEQ ID NO: 19822 - RNA, 1623 nt, Artificial Sequence; identical to SEQ ID NO: 18321
  derived and/or modified sequence opt3 from major_capsid_protein__Norovirus__AGV76558

SEQ ID NO: 19823 - RNA, 1623 nt, Artificial Sequence; identical to SEQ ID NO: 18321
  derived and/or modified sequence opt3 from major_capsid_protein__Norovirus__AGV76559

SEQ ID NO: 19824 - RNA, 1623 nt, Artificial Sequence; identical to SEQ ID NO: 18321
  derived and/or modified sequence opt3 from major_capsid_protein__Norovirus__AGV76560

SEQ ID NO: 19825 - RNA, 1623 nt, Artificial Sequence; identical to SEQ ID NO: 18321
  derived and/or modified sequence opt3 from major_capsid_protein__Norovirus__AGV76561

SEQ ID NO: 19826 - RNA, 1623 nt, Artificial Sequence; identical to SEQ ID NO: 18321
  derived and/or modified sequence opt3 from major_capsid_protein__Norovirus__AGV76562

SEQ ID NO: 19827 - RNA, 1623 nt, Artificial Sequence; identical to SEQ ID NO: 18321
  derived and/or modified sequence opt3 from major_capsid_protein__Norovirus__AGV76563

SEQ ID NO: 19828 - RNA, 1623 nt, Artificial Sequence
  derived and/or modified sequence opt3 from major_capsid_protein__Norovirus__AGV76564
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacaccuaauguccaccucgccccagcuguggcgcccaccuuuccuggcgaacagcuguuauucuuucguucuacuaugcccgguuguuccggguauccaagcauggaccuggauugccuccuuccucaggaguggguucaauacuucuaucaggaggcagcccccgcucagucggacguggcccuguugcgcuuugucaacccagauacgggcagagugcuauucgaauguaagcugcauaaaucuggauacguaacaguggcacacaccggccagcaugaccucguuauuccgccuaauggguauuuuagguucgauuccugggucaaccaauucuacacucuggcccccaugggaaacgguaccggccggcgacgcgcucuuuga

SEQ ID NO: 19829 - RNA, 1623 nt, Artificial Sequence; identical to SEQ ID NO: 18321
  derived and/or modified sequence opt3 from major_capsid_protein__Norovirus__AGV76565

SEQ ID NO: 19830 - RNA, 1623 nt, Artificial Sequence; identical to SEQ ID NO: 18321
  derived and/or modified sequence opt3 from major_capsid_protein__Norovirus__AGV76566

SEQ ID NO: 19831 - RNA, 1623 nt, Artificial Sequence
  derived and/or modified sequence opt3 from major_capsid_protein__Norovirus__AGV76567
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgguacagacacugaucaugacuuugaggcaaaucagaacaccaaauucacaccaguuggcgugauccaggaugggagcacuacccacaggaaugaaccccaacaguggguauugccgaguuacucuggacggaacacaccuaauguccaccucgccccagcuguggcgcccaccuuuccuggcgagcagcuguuauucuuucguuccacuaugcccgguuguagcggguauccaaacauggaccuggauugccuccuuccucaggaauggguucaauacuucuaucaggaggcagcccccgcucagucggacguggcccuguugcgcuuugucaauccagauacgggcagagugcuauucgaguguaagcugcauaaaucuggauacguaacaguggcacacaccggccagcaugaccucguuauuccgccuaacggguauuuuagguucgauuccugggucaaccaauucuacacucuggcccccaugggaaaugguaccggccggcgacgcgcucuuuga

SEQ ID NO: 19832 - RNA, 1623 nt, Artificial Sequence
  derived and/or modified sequence opt3 from major_capsid_protein__Norovirus__AGV76568
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauugugaucgacguccgccaacuggagccagugcuuauaccccugccugaugugcgaaauaacuuuuaucacuacaaucagagcaacgacccaaccaucaaguugauugcuaugcucuauacaccccugcgugccaauaacgcgggggaugacgucuucacuguuaguugcagagugcugaccaggccguccccugauuuugacuucaucuuucucguacccccaacaguggaaucucggaccaaaccuuucagcguccccguguuaacuguugaggaaaugacaaacucccgcuuuccaauuccccuggagaaacuuuucaccggaccuucaagugccuucgugguccagccacagaaugguagauguacgacugauggcguguugcuggggaccacacaacuaagcccgguaaacaucugcacuuuuaggggagacguuacccauauaacaggcucucggaauuacaccaugaaccucgcaucccagaauuggaacaauuaugaucccacggaggaaauuccugcuccacuggguacucccgacuucguggggaagauccagggaguccuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauucaggauggcaguacuacccacaggaacgagccccaacaguggguguugccgucuuacuccgggcggaauacaccuaacguacaccucgccccagcugucgcgcccaccuuuccuggagaacagcuguuauucuuucguagcacuaugcccggcuguucggguuauccaaauauggaccuggauugccuccuuccucaggagugggugcaauacuucuaucaggaggcagcccccgcucagucugacguugcccuguugcgcuuugugaacccagauacggggagaguccuauucgaauguaagcugcauaaauccggcuacgugacaguagcacacaccggacagcaugaccucgugaucccgccuaauggcuauuuuagguucgauucauggguuaaccaauucuacacucuggcccccauggggaacggaaccggucggcgacgcgcucuuuga

SEQ ID NO: 19833 - RNA, 1623 nt, Artificial Sequence; identical to SEQ ID NO: 18321
  derived and/or modified sequence opt3 from major_capsid_protein__Norovirus__AGV76569

SEQ ID NO: 19834 - RNA, 1623 nt, Artificial Sequence; identical to SEQ ID NO: 18321
  derived and/or modified sequence opt3 from major_capsid_protein__Norovirus__AGV76570

SEQ ID NO: 19835 - RNA, 1623 nt, Artificial Sequence
  derived and/or modified sequence opt3 from major_capsid_protein__Norovirus__AGV76571
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacauaaugaaucucgcaucucagaacugguccaauuaugaucccaccgaggaaauuccugcuccacuggguacgcccgacuucgucgggaagauccagggagugcuuacucagacaacccgcacugacggcucaacacgaggccacaaggccaccgucuacacggggagcgcugauuuugccccuaagcugggaagagugcaauucgagaccgacacagaucaugacuuugaagcaaaccagaauacuaaauucaccccaguuggugugauucaggauggcaguacaacucacaggaacgagccccaacaguggguauugccgucuuacuccgggcggaauaccccuaacguccaccucgccccagcuguggcgcccacauuuccuggagaacagcuguuauucuuucguagcaccaugcccggcuguucggguuauccaaauauggaccuggauugccuccuuccucaggaguggguucaauacuucuaucaggaggcagcccccgcucagucugacguggcccuguugcgcuuugucaacccagauacugggagagugcuauucgaauguaagcugcauaaauccggcuacguaacgguggcacacacaggacagcaugaccucguuaucccgccuaauggcuauuuuagguucgauucaugggucaaccaauucuacacccuggcccccauggggaacggaacuggucggcgacgcgcucuuuga

SEQ ID NO: 19836 - RNA, 1623 nt, Artificial Sequence
  derived and/or modified sequence opt3 from major_capsid_protein__Norovirus__AGV76572
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaagcgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggaacaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacuacccacaggaacgagccccaacaguggguauugccgucuuacuccgggcggaauacacacaacguccaucucgccccugcuguggcgccaaccuuucccggagaacagcuguuauucuuucguagcacuaugccuggcuguucggguuaucccaauauggaccuggauugccuccuuccacaggaguggguucaauacuucuaucaggaggcagccccugcucagucugacguggcccuguugcgcuuugucaaccccgauacggggagagugcuauucgaauguaagcugcacaaauccggcuacguaacaguggcacauaccggacagcacgaccucguuauuccaccgaauggcuauuuuagguucgauucaugggucaaccaauucuacacucuggccccuauggggaacggaaccggucggcgacgcgcuguguga

SEQ ID NO: 19837 - RNA, 1623 nt, Artificial Sequence; identical to SEQ ID NO: 18319
  derived and/or modified sequence opt3 from major_capsid_protein__Norovirus__AGV76573

SEQ ID NO: 19838 - RNA, 1623 nt, Artificial Sequence
  derived and/or modified sequence opt3 from major_capsid_protein__Norovirus__AGV76574
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccucauuccacaggaguggguucaauacuucuaucaggaggcagccccugcucagagcgacguggcccuucugcgcuuugucaaucccgauacgggcagaguguuguucgaauguaagcuacacaaaucgggauacguaacaguggcacauaccggccagcacgaccugguuaucccaccgaacggguauuuuagguucgauucuugggucaaccaauucuacacucucgccccuaugggaaaugguaccggccggcgacgcgcuguguga

SEQ ID NO: 19839 - RNA, 1623 nt, Artificial Sequence
  derived and/or modified sequence opt3 from major_capsid_protein__Norovirus__AGV76575
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugauaaugacuuugaagcaaaccagaauaccaaauucacaccaguuggugugauccaggauggcgggacuacccauaggaacgagccccaacaguggguauugccgagcuacaguggacggaauacacacaacguccaccucgccccugcuguggcgccaaccuuucccggcgaacagcuguuauucuuucguucuacuaugccugguuguuccggguaucccaauauggaccuggauugccucauuccacaggaguggguucaauacuucuaucaggaggcagccccugcucagagcgacguggcccuucugcgcuuugucaaccccgauacgggcagaguguuguucgaauguaagcuacauaaaucgggauacguaacaguggcacacaccggccagcaugaccugguuaucccaccgaacggguauuuuagguucgauucuugggucaaucaauucuacacucucgccccuaugggaaacgguaccggccggcgacgcgcuguguga

SEQ ID NO: 19840 - RNA, 1623 nt, Artificial Sequence; identical to SEQ ID NO: 18319
  derived and/or modified sequence opt3 from major_capsid_protein__Norovirus__AHA44844

SEQ ID NO: 19841 - RNA, 1623 nt, Artificial Sequence
  derived and/or modified sequence opt3 from major_capsid_protein__Norovirus__AHA44847
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccaucuuaacugucgaggaaaugacaaauagccgcuuuccaauaccccuggagaaacuuuucaccggaccuuccucagccuucgugguucagccacagaacgguagauguacgacugauggcguguugcuggggaccacacaacuaaguccggucaauauuugcacuuuuaggggagacaucacccauauuacaggcagccggaacuacaccaugaaucucgcaucucagaacuggaauaacuaugaucccacggaggaaaucccugcuccacuggguacucccgacuucguggggaagauccagggaguacuuacacagaccacucgcgccgacggcuccacacgaggccacaaggcuauuguuuacaccgggucagccgauuuugcaccuaagcugggaagagugcaauucgagacggacaccgaucaugacuuugaagccaaucagaacacaaaauucacuccagucggugugacccaggauggcagcacaacucacaggaaugagccccaacagugggucuugccgaguuacucugggcggaacacccacaaugugcaucucgcuccugcgguugcaccaacauuucccggagaacagcuguuauucuuucguuccaccaugccuggcuguagcgguuaucccaacauggaccuggauugccuccuuccacaggagugggugcaauacuucuaucaggaggccgcuccugcccagucggacguagcacuguugcgcuuugucaaucccgauacugggagagugcuauucgaauguaagcugcacaaaucuggcuacguuacgguggcccauacaggacagcacgaccucgucauaccaccgaacggcuauuuuagguucgauuccugggugaaccaauucuacacccuggcuccuauggggaauggaacuggucggcgacgcguaguguga

SEQ ID NO: 19842 - RNA, 1623 nt, Artificial Sequence
  derived and/or modified sequence opt3 from major_capsid_protein__Norovirus__AHB62404
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcuccucaaacuacaccaugaaucucgccagccagaacuggaauaguuaugauccgacggaggaaauccccgcaccucuggguacuccagacuucguugggaagauucagggagugcuuacacagaccacucggacagacggcucuacccgcggccacaaggcuacggucuacaccggguccgccgauuuuagccccaagcugggacgagugcaauucgcuacagacacugauaacgacuuugagaccaaucagaacacaaaauucacuccugucggugugauccaggauggcgccaccacacauagaaaugaaccacaacaguggguuuugcccucguacucugggaggaacacccacaaugugcaccucgcaccggccguagcuccuacuuuuccaggagagcagcuguuauucuuucgguccacgaugcccggcuguucagguuauccuaacauggaccuggauugccuccuuccccaggaauggguccaauacuucuaucaggaggcggcaccagcccagagugacguggcucuguugcguuuuguuaauccugauacagggcgcgugcuauucgaguguaagcugcauaaaagcggcuacgucaccguggcccacacuggacagcaugaccucguaauucccccaaacggcuauuuuagauucgauuccugggugaaccaauucuacacccuggcaccgauggggaauggaacagguaggcggcgagcccuuuga

SEQ ID NO: 19843 - RNA, 1623 nt, Artificial Sequence; identical to SEQ ID NO: 18321
  derived and/or modified sequence opt3 from major_capsid_protein__Norovirus__AHB62406

SEQ ID NO: 19844 - RNA, 1623 nt, Artificial Sequence
  derived and/or modified sequence opt3 from major_capsid_protein__Norovirus__AID51515
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugccggggaccacacaacugagucccguuaauauuugcacuuuuaggggagacgugacccauaucacaggcagccggaacuacaccaugaaucuagcaucucagaacuggaauaacuaugauccuacggaggaaauaccagcuccccucgguacuccugacuucgucgggaagauucagggagugcugacacagaccacucgcuccgacggcucaacacgaggccacaaggccaccgucuacacggggagcgcugauuuugccccaaaacuuggaagagugcaauucgagaccgacacagauagggacuuugaagcaaaucagaacacuaaguucacccccguuggugugauccaggauggcgggacaacucaucggaaugagccgcaacaguggguacugccuaguuacucuggacguaacaccccaaauguccacuuggcccccgcuguggcgccuacauuucccggcgaacagcuccuguucuuucgcuccaccaugccagguuguagcggguauccuaacauggacuuagauugccugcucccccaggaguggguucaauacuucuaucaggaggcagccccagcucagucggacguggcccuucugagauuugucaauccggauacuggcaggguguuguucgaauguaagcuacacaaaucuggauacguaacgguggcacauacaggccagcacgaccugguuauuccucccaacggguauuuucgguucgauuccugggucaaccaauucuacacccucgccccaaugggaaaugguacuggccgacgcagagcucuguga

SEQ ID NO: 19845 - RNA, 1623 nt, Artificial Sequence; identical to SEQ ID NO: 18313
  derived and/or modified sequence opt3 from major_capsid_protein__Norovirus__AID51517

SEQ ID NO: 19846 - RNA, 1623 nt, Artificial Sequence
  derived and/or modified sequence opt3 from major_capsid_protein__Norovirus__AID51519
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacuacccacaggaacgagccccaacaguggguauugccgucuuacuccgggcggaauacaccuaacguccaccucgccccagcuguggcgcccaccuuuccuggagaacagcuguuauucuuucguagcacuaugcccggcuguucggguuauccaaauauggaccuggauugccuccuuccucaggaguggguucaauacuucuaucaggaggcagcccccgcucagucugacguggcccuguugcgcuuugucaacccagauacggggagagugcuauucgaauguaagcugcauaaauccagguacguaacaguggcacacaccggccagcaugaccucguuauuccgccuaauggauauuuucgguucgauucaugggucaaccaauucuacacucuggcccccaugggcaacgggaccggacgacgcagagcucuuuga

SEQ ID NO: 19847 - RNA, 1623 nt, Artificial Sequence
  derived and/or modified sequence opt3 from major_capsid_protein__Norovirus__AID51522
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugauagggacuuugaagcaaaucagaacaccaaauucacaccaguuggugugauccaggauggcucuacuacccaucggaaugagccccaacaguggguauugccguccuacagcgggcguaacacaccuaauguccaccucgccccagcuguggcgcccaccuuuccuggagaacagcuguuauucuuucgcucgacuaugcccggcuguucugguuauccaaacauggaccuggauugccuccuuccucaggaguggguucaauacuucuaucaggaggcagcccccgcucaguccgacguggcccuguugagauuugucaauccagauacggggagggugcuauucgaauguaagcugcacaaaucaggcuacguaacaguggcacauaccggacagcacgaccucguuauuccgccuaacggcuauuuucgguucgauaguugggucaaucaauucuacacucuggcccccauggggaacggaaccggucgacgcagagcucuuuga

SEQ ID NO: 19848 - RNA, 1623 nt, Artificial Sequence; identical to SEQ ID NO: 18319
  derived and/or modified sequence opt3 from major_capsid_protein__Norovirus__AID51531

SEQ ID NO: 19849 - RNA, 1623 nt, Artificial Sequence; identical to SEQ ID NO: 18265
  derived and/or modified sequence opt3 from major_capsid_protein__Norovirus__AID51534

SEQ ID NO: 19850 - RNA, 1623 nt, Artificial Sequence; identical to SEQ ID NO: 18265
  derived and/or modified sequence opt3 from major_capsid_protein__Norovirus__AIL49840

SEQ ID NO: 19851 - RNA, 1623 nt, Artificial Sequence
  derived and/or modified sequence opt3 from major_capsid_protein__Norovirus__AIL49843
augaagauggccagcuccgacgcuaaccccucugauggcucagcagccaaucuggugccugaggucaacaaugaaguuauggcgcucgagccauucgugggggcugccaucgcagccccgguagcuggacagcaaaacgugauugaccccuggauaagaaauaacuuuguccaggcaccugguggcgaguucaccgugaguccaaggaaugcccccggggaaauccuuuggagcgcuccucugggaccagauuugaaccccuacuuaucccaccuggcccggauguauaauggcuacgcggguggguuugaaguucaggugauucuagcaggaaacgccuucacagcuggcaaagucaucuuugccgcagugccuccaaauuucccgacugagggccucucucccucgcagguaacgauguuuccucauauuguuguggacguccgccaacuggagccagugcuuaucccccugccugaugugcgaaacaauuucuaucacuacaaccagucaaaugacccaaccauaaaguugaucgcuaugcucuauacaccccugcgugccaacaacgcgggggaugacgucuuuacuguuagcugcagagugcugaccaggccgaguccugauuucgacuuuauuuuccucguacccccaacaguggaaucccggaccaaaccuuuuucuguccccguguuaacuguugaggaaaugacaaauagccgcuucccaaucccccuggagaaacuuuucaccggaccuuccucagccuuugugguccagccacagaacgguagauguacgacugauggcguguugcuggggaccacacaacuaaguccgguaaauauuugcacuuucaggggagacguuacccauaucacaggcagccggaacuacaccaugaaucucgcaucucagaacuggaauaacuaugaucugacggaggaaauacccgcuccucuugguacuccagacuuuguggggaagauucagggaguccugacacagaccacucgcacagacggcuccacccgaggccacaaggccacgguguacaccgggucagcugauuucgcccccaaguugggaagaguccaauuugagacagacacugaucaugacuucgaagcaaaucagaacaccaaauuuacaccuguggguguuauccaggauggcgggacuacccacaggagcgagccacaacagugggugcuccccaguuacucuggacggaauacaccgaacguacaccuggccccugcugucgcgccaaccuuccccggcgaacaguuacuguuuuuccguuccacuaugccugguuguagcggguaucccaauauggaccucgauugccuucugccacaggagugggugcaauacuuuuaucaggaggcagccccugcucagucggacguugccuugcuacgcuucgugaaccccgauacgggcagaguccuguuugaauguaagcuccauaaaucuggauacgugacaguagcacacaccggccagcaugaccuggugauuccaccgaauggguauuucagguucgauuccuggguuaaccaauuuuacacucuugccccuaugggaaacgguaccggccggcgacgcgcucuguga

SEQ ID NO: 19852 - RNA, 1623 nt, Artificial Sequence
  derived and/or modified sequence opt3 from major_capsid_protein__Norovirus__AIV99914
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggacauauaauggcuacgcggguggguucgaagugcaggucauucuagcaggaaacgccuuuacugcuggcaaagugaucuucgccgcaguaccuccaaauuuuccgacggagggccucucucccucgcagguuaccauguucccucauauuguggucgacgcucgccaacuggagccagugcuuaucccccugccugaugugcgaaacaauuuuuaucacuacaaccagucaaaugacccaacaauaaaguugaucgccaugcucuauacuccccugcgugcgaacaacgccggggaugacgucuucaccguuagcugcagagugcugacaaggccgaguccugauuuugacuucauuuuucucguacccccaaccguggaaucccggacuaaaccuuucucuguccccguguuaacaguugaggaaaugaccaauagccgcuuuccaaucccccuggagaaacuuuucacgggaccuuccucagcauucgugguccagccacagaacaguagauguacuaccgaugguguguugcugggcacaacucaacuaagcccgguaaauauuugcaccuuuaggggagacguuacacauaucaccgggucucggaacuacacgaugaaucucgcuucccagaacuggaauaacuaugaucccacugaggaaauaccugugccacugggcacacccgacuucgucgguaagauucagggggugcuuacccagacuacacgcaccgacggaucaacgcgaggccacaaggccaccgucuacacaggcagcgcugauuuugccccuaagcuggggagagugcaauucgagacugacaccgaucaugacuuugaagcaaaucagaacacaaaauucacuccaguuggagugauccaggaugguggcaccacacacaggaaugagccccaacaguggguauugccgaguuacucugggcggaacacccacaauguccaucucgccccugcuguggcgccaacuuuucccggagaacagcuguuauucuuucguuccacgaugccuggcuguagcgguuaucccaacauggaccuggauugccuccuuccacaggaguggguucaauacuucuaucagggggcagccccugcucagucggacguggcccuguugcgcuuugucaaucccgauacaggcagagugcuauucgaguguaagcugcacaaaucuggauacguaaccguggcacauacuggccagcacgaccucguuauuccaccgaacggguauuuuagguucgauuccugggucaaccaauucuacacccuggccccuaugggaaaugguacaggccggcgacgcgcuguguga

SEQ ID NO: 19853 - RNA, 1635 nt, Artificial Sequence
  derived and/or modified sequence opt3 from major_capsid_protein__Norovirus__AJP13619
auggccagcaaggacgcuccccaguccgcagauggcgccucuggggcgggacaacuggugccugaggucaacaccgcugacccacucccgauggaacccguugccgguccuacaacugcaguggccacggcuggccagguaaauaugaucgauccauggauugugaacaauuucguccagucaccccagggggaguuuaccauaaguccuaacaauacaccaggagacauccuuuucgaucugcaauugggcccccacuuaaacccuuuucugagccaucuaucccagauguacaaugguuggguggggaacaugagaguuaggauucuccuggcaggaaaugccuucucugcuggcaaaaucauugugugcugugucccaccgggcuuuacuucgucaagccuuaccaucgcccaggcgacacuguucccccacgugauagcagacguacggaccuuggaaccuaucgagaugccacucgaagauguucgcaacgugcuguaucauacuaaugacaaccagcccacaaugcgacuggucugcaugcucuacaccccuuuacguacugggggagguaguggcaauuccgauucuuuugugguggccgggagaguccugacggcuccaagcuccgacuucucauuucuuuucuugguucccccgaccauugagcaaaagacaagggccuuuacugugccuaacaucccccugcagacccuaaguaauagccgguucccaucucucauucagggaaugauccuguccccugaugcaucacagguagugcaauuucagaacggccgcugucuuauagacggucagcuguuggggacaacccccgcuacgagcggacaacucuucagagucaggggcaaaauuaaccagggcgcccggacucugaauuuaacagagguggaugggaagccauucauggcguuugacagucccgccccuguuggauucccagacuuugguaaaugcgauuggcacaugcgcaucucuaagaccccgaacaauacuuccagcggcgaccccaugcgaucggugucuguccagacaaacgugcagggguucguaccucaucugggauccauucaauuugaugaaguuuucaaucacccaaccggcgacuauaucgguacgaucgaguggauuucacagcccaguaccccuccagggacagauauaaaccucugggaaauccccgacuacggcagcucccuuucucaggcagcuaaucuggccccgccuguguuuccacccggauucggcgaggcuuuggucuauuuugugagcgccuucccugggcccaacaauagaucagcaccaaacgaugucccuugucuacugccccaggaguacauuacucacuuugugagugaacaagccccaaccaugggagacgcugcgcuccugcauuauguugauccggacacaaauaggaaccuuggugaguucaagcuguacccuggcggguacuugacuugcgugcccaauggaguaggcgcagguccacagcagcucccccugaacggggucuuuuuauucguguccuggguuagccgguucuaucagcugaaaccugugggcaccgccucuacagcucguggacgccuaggcgucagaaggaucuga

SEQ ID NO: 19854 - RNA, 1632 nt, Artificial Sequence
  derived and/or modified sequence opt3 from major_capsid_protein__Norovirus__AJP13620
auggccagcaaggacgcucccaccaacauggauggcacauccggggcaggacagcuggugccugaggccaauacugcggaaccaaucucuauggagccggucgcuggugccguuacggcagccgcuaccgcaggccaagugaacaugauugaccccuggauaaugaauaacuacguacaggccccucagggggaguucacaaucucaccaaauaacacucccggagauauucucuuugaccuucagcugggcccucacuugaauccauucuuaagucaucuggcucaaauguauaacgguuggguggggaauaugaaagucagagugcuacucgccggaaacgcguuuaccgcaggcaagaucauuaucagcugcauacccccuggcuucguugcccagaauaucuccauugcucaggccacaauguuuccacacgugaucgcagaugucagggugcuggaaccgauugaaguaccccuugaggacguucggaacgugcuguuccauaauaacgauaauaccccuacuaugcgcuuggucuguauccucuacacaccacugcgagcuucugggucgucaagcggaaccgaccccuuugugauagccggucgugugcugacgugcccuaguccagauuucuccuuucucuucuuaguucccccgaacgucgagcagaaaacuaagccuuuuucugugcccaaccugccacuuaauaccuugagcaacuccagaguaccuucacugauuaaaaguaugauggugagcagggaccacggccaaaugguccaguuccagaaugggcgggugacacuagauggacagcuccaaggcacuacccccacaucugcgucccagcuguguaagauccgcgguucaguuuuucaugccaacgggggaaauggcuauaaccuuaccgaacuggacggcagcccauaccacgcauucgagagucccgcuccuauuggguucccagauuugggagaaugcgacuggcacauggaggccucuccgacgacucaguuuaauacaggugacgugaucaagcaaaucaacgucaaacaggaguccgcuuucgcaccccaucucggcaccauucaggccgaugggcugagcgacgugucgguaaauacuaacaugauagccaaguuaggauggguuucuccuguguccgauggccacaaaagagacgucgauccaugggugauccccagguaugguucaacacugaccgaagcugcgcagcucgcaccuccaauuuaucccccgggguuuggcgaggccaucgucuucuuuaugagugacuucccuauagcucauggaacgaauggccuuagcgugccauguaccauuccccaagaauuuguuacacacuucgugaacgagcaggccccuacucgcggggaagcagcccuguugcacuaccuagaucccgacacccaucggaaucugggagaguuuaagcucuacccagaugguuucaugacaugcguaccuaacacuuccggcaccgggccccagacacugccaaucaauggagucuuuguguucguuucuugggugagccgauuuuaccagcuuaaaccggucggcaccgcugguccugccagaaggcuggggauccggcguucauga

SEQ ID NO: 19855 - RNA, 1647 nt, Artificial Sequence
  derived and/or modified sequence opt3 from major_capsid_protein__Norovirus__AJP13621
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugauugccaugcuguacacuccccucagagcaaauaacucuggagaugacguuuucacagugucguguagggucuuaacucggccuucaccagauuuuagcuucaauuuucuggugcccccgaccguggagaguaagacaaaaccuuucucccuucccaucuugaccauaucugaaaugagcaacucccgcuuuccagucccuauugacucacugcauaccagucccacagagaauaucguugugcagugccagaacgguagaguaacccuagauggcgagcucauggggacgacucaacugcuuccaagccagauuuguaccuucaggggagugcugacacggucuacuucccgcgcuucagaccaggccgauaccgcuacaccccgauuguucaauuauuacuggcacauccagcucgacaaccugaauggcaccccuuaugacccagccgaagauaucccgggucccuuagggacgccugacuuuagaggaaaggucuucggcguggcaagccaaaggaacccagauaguacuacacgggcccaugaggcuaaaauugacaccacuucuggccguuuuacacccaagcuggggucccucgaaauaagcaccgagucggaugacuucgaucagaauaagccuacgcgcuuuaccccaguuggaaucgguguggaccacgaagcggauuuccagcaaugggcacuucccgacuacgccggccaguuuacacacaacaugaaucuggcuccggccgucgcaccuaacuucccaggggagcaguugcuauuuuucagaucucagcugcccuccucaggaggcaggaguaaugguauucucgauugccuggugccucaagaguggguacagcauuuuuaccaggaaagcgcccccucccagucucaaguugcucuugugcgguauaucaacccagacacugggcgaguccuguucgaggccaaauugcacaagcucggcuuuauaaccauugcgaaaaacggagacagcccuaucacagugcccccaaauggcuacuuccgcuucgaaucaugggucaacccguuuuauacucuggcaccuauggggaccggaaaugguagaaggcggauccaguga

SEQ ID NO: 19856 - RNA, 1653 nt, Artificial Sequence
  derived and/or modified sequence opt3 from major_capsid_protein__Norovirus__AJP13622
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagauaacauuucugcugcccagaucacuaugugcccgcacguuauaguggacguccgccagcuugaacccgugcuguugccucucccagauauccgaaauagauuuuuccauuauaaccaggagaauacgccccguaugaggcugguggcaaugcuguacaccccucuccgggcuaacucgggcgaagacgucuuuacaguuucaugucgcguguuaacuagaccagcccccgauuucgaguuuaccuuccugguaccgccuacaguggagagcaagaccaaacccuuuacucuuccaauuuugacacugggcgaacuaaguaacuccagguucccugcggccaucgacaugcucuauaccgaucccaaugagucuauugucgugcaaccacagaacgggcggugcacgcuggacggaacucuucaggguaccacacagcugguucccacucaaaucugugcauuucgcggcaccuugauaagccagacagcucgagccgcugauuccaccgacucaccucagagagccagggaucacccacuccaugugcaagucaagaaucuggacgggacgcaguacgacccgacugaugacauucccgcaguguuaggagccaucgauuucaaaggcacaguauucgguguugcuagucagcgggacgugagcgggacccaggaacaaggacacuaugcgacucgugcacacgaggcccauauugauacaaccgacccuaaguacgcuccaaagcugggcacgauccucaucaaaucugaauccaccgauuuuacaacuaaccagcccauucgcuucaccccugucggcaugggggacaauaacuggagacagugggagcuuccagauuacucaggaaggcugacauugaauaugaaccuagcccccgcagugagcccgaguuuuccuggugagcggauacuguucuuucgaucuaucgucccauccgccggcggguucggaagcggcuauauugacugccucaucccccaggaaugggugcaacacuuuuaccaggaggcugccccuucgcagucugcaguugcgcuggugcgcuauguaaaucccgauacugguagaaacauauucgaagcuaaacuucauagggagggguuucugaccgucgccaauuccggcaacaauccaauugugguuccucccaacggauacuuccgguuugaagcaugggugaaucaguucuauacauuggccccaaugggcucagggcaaggacgcagaagggcucaguga

SEQ ID NO: 19857 - RNA, 1614 nt, Artificial Sequence
  derived and/or modified sequence opt3 from major_capsid_protein__Norovirus__AJP13623
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuuagccggauguauaauggcuacgcuggugggguggagguucaggugcuguuggccggaaacgcguucacggcaggcaaacucgucuuugccgcugugcccccucauuucccacuggaaaauaucuccccgggccagauuaccauguuuccccacguaaucauugauguucgcacacuggagccugugcucuuaccacugcccgacguccgaaacaauuucuuucauuauaaccagcaaaacgaaccucguaugagacuuguggccauguuguacacuccacugaggucuaaugggucgggagaugacguguucaccgucucaugccggguucuaacacgccccagcccggauuuugacuucaacuaucucgugccucccaccguagagaguaagacuaaaccauuuacacugccuauccuuaccauaggugagcugacuaauuccagauuccccgugccaaucgaugaauuguacacgucucccaacgagagccucgucgugcagccucagaaugggaggugugcacuggacggcgaauuacagggaaccacacaacugcucccaacugcuauuugcuccuuucggggccgcaucaaccagaagguuucaggugauaaucacguguggaacaugcaggucaccaauauuaacgggacaccguucgaccccaccgaggaugugccugccccacuuggaacgcccgacuucaguggcaaacuguuuggcguauugagccagcgagaccaugauaaugcguguagaucucacgacgccguuaucgcaacugauuccgcuaaguucacaccuaagcuaggggccauacaaauuggaaccugggaagaggacgaugugcacaucaaccagccaacuaaauuuacacccgucggucuguucgagagggaaggcuuuaaucaguggacccucccgaacuauucaggggcucugacgcuuaauaugggacuggccccuccaguggcacccaccuucccuggcgagcaaauuuuguuuuuccggagccauaucccccucaaggguggggucgccgacccagugaucgauugccuguuaccucaggaauggauucagcaccuguaccaggagagugcucccucucaaacagacguugcgcuaauacguuuuacuaacccagauaccggccgcguacucuucgaagcaaaacugcauagauccggauacaucacaguggccaacacuggcagcaggccgauugucgugccugcuaauggguauuuucgguucgacucguggguuaaccaguuuuacucucuugcccccaugggaaccgguaauggccgacgcagagugcagaagggguga

SEQ ID NO: 19858 - RNA, 1623 nt, Artificial Sequence
  derived and/or modified sequence opt3 from major_capsid_protein__Norovirus__AJW67354
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccugugcagggcauguuugucucccccgacgugaaccagucaguucaauuccagaaugguagaugucagaucgaugggcaacugcagggaacaacuccagugagucuuagccagcugugcaagauaaggggcaaaaccucuuccaacgcacgggucuugaaccucucagagguggacggcacacccuucauuccucuggaaagcccagcuccgguaggguuucccgacuuaggagguugugauuggcacguuaauuucaccuuucagacgcaagaccgcgauccuagucagucugugacuuucgccacaaacgacgcuuccuuugucccauaucugggcagcgugucgccccauaauggggagggauuccaggccggcgauaucauugguucucucggguggaucuccgcaccuucagacaacagucaguuuaaugucugggccaucccaaaguacggcagcucccuucccgaugugacccaccuggcuccggcgguuuucccuccaggauuuggcgaagugauuuuguauuucuacucuacuuuucccgggagcggacaaccuucacagcuacagguacccugccugcucccacaggaguucauaacacacuuuuguaacgagcaagcaccuaucgccggugaagcugcccugcuucauuaugucgaccccgauaccggccgaaaucugggggaguucaaguuguacccagacggauucaugacgugcgugccgaacaguguuuccagcggcccucagacccuccccauuaaugguguguuugucuucgugucuuggguaucaagauuuuaccagcugaaaccaguggggacagcaagugccgcuaggcgguuaggccugcgucgcaucuga

SEQ ID NO: 19859 - RNA, 1644 nt, Artificial Sequence
  derived and/or modified sequence opt3 from major_capsid_protein__Norovirus__AJW67357
augaagauggccagcaacgacgcugcacccuccaaugauggcgccgcgaaccuggugccugaggcuaccaaugaagucauggcccucgagccaguugugggggcaucuaucgccgcuccgguagugggacagcaaaacauuauagaccccuggaucagagaaaauuucguccaggcaccucagggugaguuuacagugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacugcgggaaaaauuaucuuugcagccgugcccccucauuucccaguagaaaauauuucugcugcccagaucacgaugugcccgcacguuauaguggauguccgccagcuugagcccgugcuguugccucucccagacauccgaaaccguuucuuucauuauaaucaggaaaacacccccagaaugaggcugguggcaaugcuguacacaccucuccgggcuaauucgggcgaggaugucuuuacuguuucaugucgcguguuaaccagaccagcccccgacuucgaguuuacauuccugguaccgccuaccguggaaagcaagacuaaacccuuuacacuuccaauuuugacccugggcgagcuaaguaacuccagguucccugcgcccaucgauaugcucuauacggacccaaacgaagccauugucgugcaaccccagaaugggcggugcacucuggauggaacccuucaggguacaacucagcugguuccuacccaaaucuguucuuuucgcggcacauugauaagccagaccucccgaucagcagacaguacggauagcgcuccaagagugaggaaccacccgcuccauguccagcugaagaauuuagacgggacucccuacgauccuacagacgaggugccagccguacugggagcuauugacuucaaaggcaccguuuucgguguggccucucaacggaacacuacaggaaauuccaucggggcaacccgugcccacgaaguccacauugauacgaccaacccccgcuauacaccuaagcucggcucagugcuuauguacagcgagaguucugacuuugaugacggccagccaacuagauucacccccaucgggaugggagcugaugacuggcaucagugggagcugccggaauacuccggucacuugacacuaaauaugaaccuggcgccugcagucgccccagcuuuucccggcgagaggauccucuucuuucggagcgugguuccuucggccgggggauauggcucuggucauauugauugccugauaccccaggaaugggugcaacacuucuaccaggaggcagccccaucccagucagcuguagcccuuauccgauaugucaauccugacacugggcgcaacauuuuugaagcaaagcugcacagagagggcuucgugaccguugcgaauaguggaaacaaucccaucguggucccaccgaacggcuacuuuagguucgaggcuugggugaaucaguuuuauacauugaccccuauggggacuggacaaggucggcgcagaauacaguga

SEQ ID NO: 19860 - RNA, 1644 nt, Artificial Sequence
  derived and/or modified sequence opt3 from major_capsid_protein__Norovirus__AJW67359
augaagauggccagcaacgacgcugcacccuccaaugauggcgccgcgaaccuggugccugaggcuaccaaugaagucauggcccucgagccaguugugggggcaucuaucgccgcuccgguagugggacagcaaaacauuauagaccccuggaucagagaaaauuucguccaggcaccucagggugaguuuacagugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacugcgggaaaaauuaucuuugcagccgugcccccucauuucccaguagaaaauauuucugcugcccagaucacgaugugcccgcacguuauaguggauguccgccagcuugagcccgugcuguugccucucccagacauccgaaaccguuucuuucauuauaaucaggaaaacacccccagaaugaggcugguggcaaugcuguacacaccucuccgggcuaauucgggcgaggaugucuuuacuguuucaugucgcguguuaaccagaccagcccccgacuucgaguuuacauuccugguaccgccuaccguggaaagcaagacuaaacccuuuacacuuccaauuuugacccugggcgagcuaaguaacuccagguucccugcgcccaucgauaugcucuauacggacccaaacgaagccauugucgugcaaccccagaaugggcggugcacucuggauggaacccuucaggguacaacucagcugguuccuacccaaaucuguucuuuucgcggcacauugauaagccaggcaucccgaucagcugacaguaccgauagcgccccaagagugaggaaccacccgcuccauguccagcugaagaauuuagacgggacgcccuacgauccuacugacgaggugccagcuguacugggagccauugacuucaaaggcacaguuuucgguguggcaucucaacggaacaccacuggaaauuccaucggggccacacgugcucacgaagcgcacauugauaccacgaacccccgcuauaccccuaagcucggcucaguccuuauguacagcgagaguucugacuuugaugacggccagccaacaagauucacucccaucgggaugggagcagaugacuggcaucagugggagcugccggaauacuccggucacuugacccuaaauaugaaccuggccccugcuguggccccagcauuucccggcgagaggauccucuucuuucggagcgucgugccuucggccgggggauauggcucuggucauauugauugccugauaccccaggaauggguucaacacuucuaccaggaggcugccccaucccagucagcaguggcgcuuauccgauauguaaauccugacacagggcgcaacauuuuugaagcuaagcugcacagagagggcuucaucacugucgccaauaguggaaacaaucccauagugguuccaccgaacggcuacuuuagguucgaggcaugggugaaucaguuuuauaccuugacaccuauggggaccggacaaggucggcgcagaguccaguga

SEQ ID NO: 19861 - RNA, 1644 nt, Artificial Sequence
  derived and/or modified sequence opt3 from major_capsid_protein__Norovirus__AJW67362
augaagauggccagcaacgacgcugcacccuccaaugauggcgccgcgaaccuggugccugaggcuaccaaugaagucauggcccucgagccaguugugggggcaucuaucgccgcuccgguagugggacagcaaaacauuauagaccccuggaucagagaaaauuucguccaggcaccucagggugaguuuacagugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacugcgggaaaaauuaucuuugcagccgugcccccucauuucccaguagaaaauauuucugcugcccagaucacgaugugcccgcacguuauaguggauguccgccagcuugagcccgugcuguugccucucccagacauccgaaaccguuucuuucauuauaaucaggaaaacacccccagaaugaggcugguggcaaugcuguacacaccucuccgggcuaauucgggcgaggaugucuuuacuguuucaugucgcguguuaaccagaccagcccccgacuucgaguuuacauuccugguaccgccuaccguggaaagcaagacuaaacccuuuacacuuccaauuuugacccugggcgagcuaaguaacuccagguucccugcgcccaucgauaugcucuauacggacccaaacgaagccauugucgugcaaccccagaaugggcggugcacucuggauggaacccuucaggguacaacucagcugguuccuacccaaaucuguucuuuucgcggcacauugauaagccagaccucccgaucagcagacaguacggauagcgcuccaagagugaggaaccacccgcuccauguccagcugaagaauuuagacgggacucccuacgauccuacagacgaggugccagccguacugggagcuauugacuucaaaggcaccguuuucgguguggccucucaacggaacacuacaggaaauuccaucggggcaacccgugcccacgaaguccacauugauacgaccaacccccgcuauacaccuaagcucggcucagugcuuauguacagcgagaguacugacuuugaugacggccagccaaccagauucacacccaucgggaugggagcugaugacuggcaucagugggagcugccggaauacucuggucacuugacucuaaauaugaaccuggcgccugcagucgccccagcuuuucccggcgagaggauccucuucuuucgguccgugguuccuagcgccgggggauauggcucgggucauauugauugccugauaccccaggaaugggugcaacacuucuaccaggaggcagccccaucucaguccgcuguagcccuuauccgauaugucaauccugacaccgggcgcaacauuuuugaagcaaagcugcacagagagggcuucaucacaguggcuaauucaggaaacaaucccauaguugugccaccgaacggcuacuuuagguucgaggcgugggucaaucaguuuuauaccuugacuccuauggggacgggacaaggucggcgcagagugcaguga

SEQ ID NO: 19862 - RNA, 1617 nt, Artificial Sequence; identical to SEQ ID NO: 19428
  derived and/or modified sequence opt3 from major_capsid_protein__Norovirus__AJW67368

SEQ ID NO: 19863 - RNA, 1617 nt, Artificial Sequence; identical to SEQ ID NO: 19428
  derived and/or modified sequence opt3 from major_capsid_protein__Norovirus__AJW67371

SEQ ID NO: 19864 - RNA, 1623 nt, Artificial Sequence
  derived and/or modified sequence opt3 from major_capsid_protein__Norovirus__AJW67374
auggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaagauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaaaacaaagcccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaaaaacgcuaagggcguguacaucaguacuacaucugggcgauuuacccccaaaauuggaacgauagguuugcauuccaucaccgaaaauguccacccuaaccagcaaagcagauucacaccagugggcguagcccagaaugagaacacucccuuccagcaguggguucuaccgcauuaugcaggggcccuggcucucaauaccaaccuggcgccugcaguggccccaacauuucccggagagcaacuucuguucuuuaggucgcgggucccuugcgugcagggcuugcguggucaggacgcuuucauugauugucuccugccccaggaaugggucaaucacuuuuaccaagaggccgcaccaucucaggccgacguggcuuuaauccgcuauguuaacccugauacugggagaacccuguucgaagccaagcuacacagguccggcuuuauaacagugucacauaccggaaacuacccccucguagucccaccgaauggccacuuccgguuugacaguugggugaaccaguucuauagccuggcaccuauggggacuggaaauggucgacgcagaguucaguga

SEQ ID NO: 19865 - RNA, 1635 nt, Artificial Sequence
  derived and/or modified sequence opt3 from major_capsid_protein__Norovirus__AJW67377
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaaaaagucuugaaccucacugagcuggacgggagcccauucauggcauucgcugccccggcgcccgccggauuuccugauuuagguucuugcgacuggcacauugagauguccaagaucccaaauucaagcacagaaaguaaccccauugugguaaauucuguuaagccuaacucccagcaguucgugccacaucugagcucgaucacccucgaugacaaugucucuuccggcggggauuacaucggaacgauucaguggaccucacccccgagugacagcggcggugcaaacacaaauuuuuggaaaauaccuaacuauggguccucucuugcugaggccagccaacuggcuccagccguguaucccccuggcuucaaugaagucaucguguacuuuauggcaucaauucccggaccaaaccagaguggcuccccuaauuugguucccugucuacugccacaggaguacaucacucacuucauaagcgagcaggccccgauucaaggggaagcugcgcuccugcacuacguggauccugacaccaaccgcaaucuuggagaguuuaagcuguaucccgguggcuacuugacaugcguaccaaacucuucaaguacugggccccagcagcucccucuggauggagucuucguguuugcaagcuggguuucccgauucuaucaguuaaaaccagugggcaccgccggucccgcuagagggaggcugggcguccggcguuga

SEQ ID NO: 19866 - RNA, 1617 nt, Artificial Sequence
  derived and/or modified sequence opt3 from major_capsid_protein__Norovirus__AJX18190
auggccagcaacgacgcuacccccuccaaugauggcgcagccgggcuggugccugagucuaacaaugaagcgauggcucucgagccagucguuggagccucacuugcagccccggugacaggucagacuaacaucauugaccccuggauaagaacgaauuucguacaagcuccuaacggcgaauuuaccgugaguccaaggaauagccccggggagauccuggucaacuuggaauuaggaccugagcugaauccauaccuagcacaccucgcccggauguauaacggcuacgcuggugggauggaggugcagguuaugcuggccggaaaugcguucacagcaggcaagauuaucuuugccgcugugcccccuuauuucccagucgaaaaccuuuccccgccccagauuacuauguuuccucaugugaucauagauguacgcacccuggagccaguuuugcuccccaugccugacgugcgaucuacacuguuccacuuuaaucagaaagaugaaccaaagaugcgucuggucgccaugcucuacacccccuuaagaucgaacggcucaggggacgauguguucacugugagcugcaggauccugacacggccgaguccugaguuugacuucaccuaucuuguucccccaacggucgaguccaaaacuaagccuuuuaccuugcccgugcugacacuaggagaacucucuaauagccgcuucccacuguccauugaugagaugguaacuucacccaacgaaaguaucgugguccaaccucagaacgguagagugacccuugacggcgagcuguuggggacaacccagcuccaggcauguaauauuugcagcaucaggggaaaaguuacgggccaagugccaaacgaacagcauauguggaaucuggagauaacuaacuuaaaugguacacaguuugauccgaccgacgauguccccgcuccucugggggugccagacuucgccggagagguauucggcguucucucucagcggaaccgcggcgaauccaaucccgcgaaccgagcccacgacgcaguggucgcuacuuacucagauaaguauacaccuaaacuugggcuggugcaaauuggaaccuggaauacgaacgacgucgagaaucagccaaccaaguuuacacccaucgguuugaacgaaguggccaauggccauagauucgagcaguggacucuaccgagguacagcggggcucugacccucaacaugaaucuggccccugcaguugccccacuuuuucccggagaacggcuguuguucuuucguaguuacgugccucucaagggcgguuucgggaaccccgcuauugauugucugguaccacaagaguggguccagcacuuuuaucaggagucugcgccuuccuuaggcgacguggcacugguucgcuacgugaaccccgauacaggaagaguccuauucgaagccaaacuccacaagggcggguuucugacugugagcucgaccucuacaggaccaguagugguuccggcuaaugguuauuucagguuugacuccugggucaaccaguucuacucacuugccccuaugggcaccgggaauggacggcgacgcuuucaauga

SEQ ID NO: 19867 - RNA, 1617 nt, Artificial Sequence; identical to SEQ ID NO: 19428
  derived and/or modified sequence opt3 from major_capsid_protein__Norovirus__AJX18193

SEQ ID NO: 19868 - RNA, 1623 nt, Artificial Sequence; identical to SEQ ID NO: 18442
  derived and/or modified sequence opt3 from major_capsid_protein__Norovirus__AJZ77004

SEQ ID NO: 19869 - RNA, 1623 nt, Artificial Sequence; identical to SEQ ID NO: 18163
  derived and/or modified sequence opt3 from major_capsid_protein__Norovirus__AJZ77010

SEQ ID NO: 19870 - RNA, 1623 nt, Artificial Sequence
  derived and/or modified sequence opt3 from major_capsid_protein__Norovirus__AJZ77013
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaacucccgcuuuccaauaccccuggagaaacuuuucacgggaccuucaagugcguucgugguucagccacagaaugguagauguacuaccgauggcguguugcuggggacaacucaacuaagcccggucaacauuugcaccuuuaggggagacgugacacauaucaccggcucucggaauuacacgaugaaccucgccacucagaauuggaacuccuaugaucccacagaggaaauuccugcaccacuggguacccccgacuucguagggaagauccagggaguucuuacucagacaacccgcgcugacggcucaacgcgaggccacaaggccaccguguacacagggagcgcugauuuugccccuaagcugggaagaguccaauucgcaacugacaccgauaaugacuuugaugccaaccagaauacaaaauucacuccagugggugucauccaggacggcgauaccgcucauaggaacgagccccaacaguggguguugccgaguuacucugggcguaauucccacaacguucaccucgcgccugcaguggccccaacauuucccggagaacagcuguuauucuuucggagcaccaugccuggcuguucggguuaucccaauauggaccuggauugccuccuuccacaggaguggguacaauacuucuaucaggaagcugccccugcacagucugacgucgcccuguugcgcuuugugaaccccgauacugggagaguucuauucgaguguaagcugcauaaauccggcuacgugacggucgcucacacaggacagcaugaccucgugauuccaccgaauggcuauuuuagguucgacucauggguaaaccaauucuacacccuggccccuauggggaacggaacuggucggcgacgcgcacuuuga

SEQ ID NO: 19871 - RNA, 1623 nt, Artificial Sequence; identical to SEQ ID NO: 18173
  derived and/or modified sequence opt3 from major_capsid_protein__Norovirus__AJZ77015

SEQ ID NO: 19872 - RNA, 1623 nt, Artificial Sequence; identical to SEQ ID NO: 18171
  derived and/or modified sequence opt3 from major_capsid_protein__Norovirus__AJZ77019

SEQ ID NO: 19873 - RNA, 1623 nt, Artificial Sequence; identical to SEQ ID NO: 18265
  derived and/or modified sequence opt3 from major_capsid_protein__Norovirus__AJZ77022

SEQ ID NO: 19874 - RNA, 1623 nt, Artificial Sequence; identical to SEQ ID NO: 18537
  derived and/or modified sequence opt3 from major_capsid_protein__Norovirus__AJZ77027

SEQ ID NO: 19875 - RNA, 1623 nt, Artificial Sequence; identical to SEQ ID NO: 18319
  derived and/or modified sequence opt3 from major_capsid_protein__Norovirus__AJZ77030

SEQ ID NO: 19876 - RNA, 1623 nt, Artificial Sequence; identical to SEQ ID NO: 17662
  derived and/or modified sequence opt3 from major_capsid_protein__Norovirus__AJZ77033

SEQ ID NO: 19877 - RNA, 1623 nt, Artificial Sequence; identical to SEQ ID NO: 17662
  derived and/or modified sequence opt3 from major_capsid_protein__Norovirus__AJZ77036

SEQ ID NO: 19878 - RNA, 1623 nt, Artificial Sequence
  derived and/or modified sequence opt3 from major_capsid_protein__Norovirus__AKE31849
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcucccggaacuacaccaugaaucucgccucacagaacuggaauagcuaugauccgacggaggaaauccccgcaccucuggguacuccagacuucguugggaagauucagggagugcuuacacaggcuacccgcacuaacggcaguacacgaggccacaaggccaccgucuacacggggucugcugacuuuucccccaagcugggaagagugcaauucgccaccgauacagacaaugauuuugagacuaaccagaauaccaaauucacaccugucggugugauccaggacggcagcacuaccccaaggaacgaaccccaacaguggguuuugccgucguacucugggcggaauauccauaacgugcaccucgccccugcaguagcuccaacauuucccggagagcagcuguuauucuuucguuccaccaugccuggcuguucagguuaucccaauauggaucuggacugccuccuuccacaggaauggguccaauacuucuaucaggaggcggccccugcacagagugauguggcucuguugcgcuuuguuaaccccgacacugggagagugcuauucgaguguaagcugcacaaaagcggcuacgucacgguggcccauacaggacagcacgaucucguaauuccaccgaacggcuauuuuagguucgacuccugggugaaucaauucuacacccuggcaccuauggggaacggaacuggucggcgacgcgcccuuuga

SEQ ID NO: 19879 - RNA, 1623 nt, Artificial Sequence
  derived and/or modified sequence opt3 from major_capsid_protein__Norovirus__AKE31852
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacguggguggguucgaaguccaggugauucuagccggaaacgcguuuacugcaggcaaaaucauuuucgccgcuguaccuccaaauuuuccgacggagggccucucucccucgcagguuaccauguucccucauaucauaguggacguccgccaacuggagccagugcuuaucccccugccugaugugcgaaacaauuuucaccauuauaaccagucaaaugacccaacaauuaaguugaucgccaugcucuacacuccccugcgugcaaacaacgcuggggaugacgucuucaccguuagcugcagagugcugacaaggccgaguccugauuuugacuucauuuuucucguacccccaaccguggaaucccggacuaaaccuuucucuguccccguguuaacaguugaggaaaugaccaauagccgcuuuccaaucccccuggagaaacuuuucacgggaccuuccucagccuucgugguccagccacagaacgguagauguacuaccgauggcguguugcuggggacaacucaacuaaguccgguaaauauaugcaccuuuaggggagacguuacacacauucccggcagccggaacuauaccaugaaucucgcgucucagaacuggaacuccuacgauccuacggaggaaaucccagcaccccuggguacuccugacuucguggggaagauucagggaguccuuacacagaccacucgcacaaauggcucaacccgaggccauaaggccacgguguauaccgggagcgcugacuuuaguccaaagcugggaagaauccaauucgccacagauacugacaaugauuuugagaccaaccagaauacaaaauucacucccgucggugugauccaggacggcucuaccacaccgaggaacgaaccucaacaguggguuuugccauccuacagcgggcggaauacccacaacgugcaccucgcucccgccguagcaccuacuuuucccggagagcagcuguuauucuuucguucgacgaugccaggcuguucugguuacccuaauauggaucuggacugccuccuuccccaggaauggguccaauauuucuaccaggaggccgcuccagcgcaguccgauguggcacuguugcgcuuuguuaacccggacacagggagagugcuauucgaguguaagcugcauaaaucaggcuaugucaccguggcccacacuggacagcaugaucucguaauuccucccaacggcuacuuuagguucgacaguugggugaaucaauucuauacccuggcuccaauggggaacggaacaggucggcgacgcgcccuuuga

SEQ ID NO: 19880 - RNA, 1623 nt, Artificial Sequence
  derived and/or modified sequence opt3 from major_capsid_protein__Norovirus__AKE31855
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgugguccaggugauucuagcgggaaaugcauuuacugccggcaaaaucauuuucgcugccguaccuccaaacuuuccgacggaaggccucucgcccucacagguuaccauguucccucauaucauaguggacgcacgccaacuggagccaguccuuaucccccugccugaugugcgaaauaacuuuuaucacuacaaucagagcaacgacccaacaauuaaguugaucgcuaugcucuauacuccccugcgugccaauaacgcgggggaugacguguucaccgucaguugcagaguucugacaaggccguccccugauuuugacuucauuuuucucgugcccccaaccguagagucucggacuaaaccuuucagcgugcccgucuuaacaguggaagagaugaccaacucccgcuuuccaaucccccuggaaaaacuuuucacgggaccuucaagugccuucguugugcagccacagaaugguagauguacuaccgauggcgucuugcuggggacaacucaacuaagcccggugaacauaugcaccuuuaggggagacguaacacauauuucuggcucccggaauuacaccaugaaccucgcaucacagaauuggaacagcuaugaucccacggaggagaucccugcuccacuggguacucccgacuucguugggaagauucagggagugcuuacacagaccacuaagacagacggcaguacccgcggccacaaggccacggucuacaccgggucugcugauuuuuccccuaaacugggacgagugcaauucgccacagacacugauaaugacuuugaaaccaaccagaauacaaaguucacuccagucggugugauccaggauggcagcaccacacccagaaacgagccgcaacaguggguuuugccuucguacucugggaggaauacccauaacgugcaccucgcaccagccguagcucccacuuuuccuggagaacagcuguuauucuuucgguccacgaugcccggcuguucagguuauccaaauauggaccuggauugccuccuuccucaggaguggguccaauacuucuaucaggaagcggcacccgcccagagugacguggcucuguugcguuuuguuaacccagauacagggcgcgugcuauucgaguguaaacugcacaagagcggcuacgucaccguggcccauacuggacagcacgaccucguaaucccgccuaauggcuauuuuagauucgauuccugggugaaccaauucuacacccuggcacccauggggaacggaacagguaggcggcgagcccuuuga

SEQ ID NO: 19881 - RNA, 1623 nt, Artificial Sequence
  derived and/or modified sequence opt3 from major_capsid_protein__Norovirus__AKE31858
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauuucuggcucccggaauuacaccaugaaccucgccucacagaauuggaacagcuaugaucccacggaggaaaucccugcaccacuggguacucccgacuucguugggaagacacagggagugcuuacccagacuacaaagaccaauggcaguacgcgcggccacaaggcuaccgucuacacagggucugccgacuuuuccccuaaacugggacgagugcaauucgcuacugauaccgacaacgauuuugagacaaaucagaacacuaaguucaccccagucggugugauucaggacggcagcacaacccccagagaugaaccgcaacaguggguuuugccuucguacucugggaggaauacucauaacgugcaccucgccccagcaguagcccccacguuuccuggagagcagcuguuauucuuucgguccacaaugcccggcuguucagguuauccaaauauggaccuggaucgucuccuuccucaggaauggguccaauacuucuaucaggagcccgcuccagcgcagagugacguggcacuguugcgcuuuguuaacccggauaccgggagagugcuauucgagugcaaacugcacaagagcggcuacgucacuguggcccauaccggacagcacgaccucguaaucccucccaauggcuauuuuagguucgauuccugggugaaccaauucuacacacuggcuccaauggggaacggaaccggucggcgacgcgcccuuuga

SEQ ID NO: 19882 - RNA, 1623 nt, Artificial Sequence
  derived and/or modified sequence opt3 from major_capsid_protein__Norovirus__AKE31861
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcacgucucuauacuccccugagagcuaauaacgccggggaugacguguucaccgucaguugcaggguucugacacggccguccccugauuuugacuucauuuuucucgugcccccaaccguagaaucucgcacuaaaccuuucagcgugcccgucuuaacaguggaggaaaugaccaacuccagauuuccaaucccccuggagaaacuuuucacgggaccuucaagugcguucguugugcagccacagaaugguagguguacuaccgauggcgucuugcuggggacaacucaacuaagcccggugaacauaugcaccuuucggggagacguaacacauauuucuggcucccgcaauuacaccaugaaccucgccucacagaauuggaacagcuaugaucccacggaggaaaucccugcaccacuggguacucccgacuucguugggaagauucagggagugcuuacacagaccacuaagacaaauggcaguacccgaggccacaaggcuacggucuacaccgggucugccgacuuuuccccuaaacugggaagagugcaauucgcuacagauacugacaacgauuuugagaccaaucagaacacaaaguucacuccagucggugugauccaggacggcagcaccacacccaggaaugaaccgcaacaguggguuuugccuucguacucugggcggaacacccauaaugugcaccucgccccagcaguagcccccacuuuuccuggagagcagcuguuauucuuucguuccacgaugcccggcuguucagguuauccaaacauggaucuggacugccuccuuccucaggaauggguccaauacuucuaucaggaggcugcgcccgcacagagugauguggcccuguugcgcuuuguuaauccagacacagggagagugcuauucgaguguaaacugcacaagagcggcuacgucaccguggcucauacuggacagcacgaucucguaaucccgccuaacggcuauuuuagguucgacuccugggugaaccaauuccauacccuggcccccauggggaauggaacaggucggcgacgcgcacuuuga

SEQ ID NO: 19883 - RNA, 1623 nt, Artificial Sequence
  derived and/or modified sequence opt3 from major_capsid_protein__Norovirus__AKE31864
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaaggaccuuucggggagacguaacacauauucccggcagccgcaacuacaccaugaacucugccucccagaauuggaacucauaugauccuacggaggaaaucccagcaccccucgguacuccugacuucguugggaagauucagggagugcugacacagaccacucgagcuaauggcagcacaagaggccacaaggccaccgucuacacggggagugcugacuuuucuccaaaacuuggaagggugcaauucgccaccgauacagacaaugauuuugagacuaaccagaauaccaaguucacacccgucggugugauccaggacggcuccacuaccccgcggaacgaaccucaacaguggguucugccaagcuacucggggcguaauauccauaacgugcacuuggcacccgccguagcuccuacauuucccggagagcagcuccuguucuuucgcucuaccaugccaggcugcuccgguuauccuaauauggauuuagacugucugcucccccaggaauggguccaauacuucuaucaggaggcggcaccagcccagucagauguggcccuucugagauuuguuaacccggacacugggaggguguuguucgagugcaagcuacacaaaaguggcuacgucacgguggcucauacaggacagcacgaucugguaauuccucccaacggcuauuuucgguucgacagcugggugaaucaauucuacacccucgcaccaauggggaacggaacuggucgacgcagagcccuguga

SEQ ID NO: 19884 - RNA, 1623 nt, Artificial Sequence
  derived and/or modified sequence opt3 from major_capsid_protein__Norovirus__AKE31867
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccagucucaaucccccuuccugaugugcgaaacaauuuuuaucacuacaaccagagcaaugacccaacaauuaagcugaucgcaauguuguauacuccccuccgugcuaacaacgccggggaugacguguucaccgucaguugcagaguucugacaaggccguccccugauuuugacuucauuuuucuggugcccccaaccguagaaucucggacuaaaccuuucagcgugcccguccucacaguggaggaaaugaccaauucccgcuuuccaauccccuuagagaagcuguucacgggaccuucaagugcguucguugugcagccacagaacgguagauguacuaccgauggcguccuuuuggggacaacucaacugagcccggugaauauaugcaccuuuaggggagacguaacacauauucccggcucucggaacuacaccaugaaucuagccucccagaacuggaacucauaugauccuacggaggaaaucccagcaccccucgguacuccugacuucguugggaaaauucagggagugcugacacagaccacucgcgcuaauggcagcacacgaggccacaaggccaccgucuacacggggagugcugacuuuucuccaaaacuuggaagagugcaauucgccaccgauacagacaaugauuuugagacuaaccagaauaccaaguucacacccgucggugugauccaggacggcuccacuaccccgaggaacgaaccucaacaguggguucugccaagcuacucggggcggaauauccauaacgugcacuuggcacccgccguagcuccuacauuucccggagagcagcuccuguucuuucguucuaccaugccaggcuguuccgguuauccuaauauggauuuagacugccugcucccccaggaauggguccaauacuucuaucaggaggcggcaccagcccagucagauguggcccuucugcgcuuuguuaacccggacacugggagaguguuguucgaguguaagcuacacaaaaguggcuacgucacgguggcucauacaggacagcacgaucugguaauuccucccaacggcuauuuuagguucgacagcugggugaaucaauucuacacccucgcaccaauggggaacggaacuggucggcgacgcgcccuguga

SEQ ID NO: 19885 - RNA, 1623 nt, Artificial Sequence
  derived and/or modified sequence opt3 from major_capsid_protein__Norovirus__AKE31870
augaagauggccagcuccgacgcuaaccccucugauggcucaaccgcaaaucuggugccugaggucaacaaugaaguuauggcccucgagccagugguaggggcgaguaucgcugccccgguggcaggacagcaaaacgucauugaccccuggauaagaaauaacuucgugcaggccccugguggcgaauuuacaguuagcccaaggaaugcucccggggagauccuuugguccgcaccucugggaccagauuugaaccccuacuuaccucaccuggcccggauguauaauggcuacgcugguggguucgaagugcaggucauucuagccggaaacgcguuuacugcaggcaaaaucauuuucgccgcugugccaccgaauuuucccacggagggccucucuccuucgcagguaaccauguucccacauaucauaguugacgugcgccaacuggagcccguccuuaucccucugccagaugugcgaaacaauuuuuaucacuacuaucagucaaacgaccccacaauuaaguugaucgccaugcucuacacuccgcugcgugcaaauaacgcuggggaugacguguucaccgucagcugcagaguucugacaaggccuagucccgauuuugacuucauuuuucucgugccaccuaccguagaaucccggacuaaacccuucucugugccagucuuaacaguggaggaaaugaccaacagccgcuuucccaucccucuggagaaacuuuucacgggaccauccucagccuucguugugcagccgcagaaugguagauguacuaccgauggcgucuugcuggggacaacucaacuaagucccgugaacauaugcaccuuuaggggagacguaacacauauuagcggcucucggaauuauaccaugaaccucgcgucccagaauuggaacucauacgauccuacggaggaaaucccagcaccccuggguacuccugacuucguugggaagauucagggagugcuuacacagaccacucgcacaaauggcagcacccgaggccacaaggccacggucuacaccgggagugcugacuuuucuccaaagcugggaagagugcaauucgccacagauacugacaacgauuuugagaccaaucagaacacaaaauucacucccgucggugugauccaggacggcuccaccacaccgaggaaugaaagccaacaguggguuuugccuucguauucugggcggaacacccauaaugugcaccucgcuccagccguagcacccacuuuuccuggagagcagcuguuauucuuucguuccacgaugcccggcuguucagguuacccaaacauggaucuggacugccuccuuccucaggaauggguccaauauuucuaccaggaggccgcucccgcgcagagugauguggcacuguugcgcuuuguuaauccagacacagggagagugcuauucgaguguaagcugcacaaaagcggcuaugucaccguggcccauacuggacagcacgaucucguaaucccgccuaacggcuacuuuagguucgacuccugggugaaccaauucuauacccuggcucccauggggaauggaacaggucggcgacgcgcccuuuga

SEQ ID NO: 19886 - RNA, 1623 nt, Artificial Sequence
  derived and/or modified sequence opt3 from major_capsid_protein__Norovirus__AKE31873
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggauguugccuagcuacucggggcggaauacccauaacguucaccucgccccagcaguggcccccacuuuuccuggagagcagcuguuauucuuucguucuacgaugcccggcuguuccgguuauccaaauauggaucuggacugccuccuuccucaggaauggguacaauacuucuaucaggaggcugcgcccgcacagucagaugucgcccuguugcgcuuugugaacccagacacagggagaguucuauucgaguguaagcugcacaaaaguggcuacgugaccgucgcucauacuggacagcacgaucucgugaucccgccuaacggcuauuuuagguucgacagcuggguaaaucaauucuacacccuggcccccauggggaacggaacaggucggcgacgcgcacuuuga

SEQ ID NO: 19887 - RNA, 1623 nt, Artificial Sequence
  derived and/or modified sequence opt3 from major_capsid_protein__Norovirus__AKE31876
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccagagaugacguguucaccgucagcugcaggguucugacacggccgaguccugauuuugacuucauuuuucucgugcccccaaccguagaaucccgcacuaaaccuuucucugugcccgucuuaacaguggaggaaaugaccaauagcagauuuccaaucccccuggagaaacuuuucacggggccuuccucagcguucguugugcagccacagaacggaagguguacuaccgauggugucuugcugggcacaacucaacuaaguccggugaauauaugcaccuuucgcggggacguaacacauauuagcggaucucggaacuacaccaugaaucucgccucccagaacuggaacucauaugaucccacggaggaaaucccugcaccacugggcacucccgacuucguugguaagauucagggggugcuuacacagaccacucgaacagacggaagcaccagaggccacaaggcuacggucuacaccggcagugccgauuuuucuccuaagcuggggagggugcaauucgcuacagacacugauaaugacuuugagaccaaucagaacacaaaauucacuccagucggagugauccaggaugguggcaccacacaucggaaugaaccccaacaguggguuuugccgaacuacuccgggcguaauacccacaacgugcaccucgccccugcaguagccccaacuuuucccggagagcagcuguuauucuuucgcagcacgaugccuggcuguucggguuaucccaauauggaccuggauugccuccuuccacaggaauggguccaauacuucuaucaggaggcugcgccugcacagucugacguggcccuguugagauuuguuaaccccgauacagggagggugcuauucgaguguaagcugcauaaauccggcuacgucaccguggcucacacuggacagcaugaccucguaaucccaccgaacggcuauuuucgguucgauucaugggugaaucaauucuacacccuggccccuauggggaacggaacaggucgacgcagagcacuuuga

SEQ ID NO: 19888 - RNA, 1632 nt, Artificial Sequence
  derived and/or modified sequence opt3 from major_capsid_protein__Norovirus__AKF02368
augaagauggccagcaacgacgcugcacccuccaaugauggcgccgcggggcuggugccugagaucaacaaugaaaccauggcucucgagccagucgccggaggugcaauugccgcuccgcuuacaggccagacuaacuucauagaccccuggaucagagggaauuacguucaagcaccuaacggagaauuuacggugucuccaaggaacucacccggcgagauucuguugaauuuagaacuggguccugagcuaaauccauuccucagucaccugagccggauguauaacggguacgccggaggcaucgauguacaggugauuauggcuggcaaugccuuuaccgcggggaaaaucauauucgcagccauucccccucauuuuccagucgagaaccuuuccccgccccagaucacaauguucccucacaucauuguggacguucgcacucuggaaccaaucaauauacccgugccugauguccgaaacaacuuuuuccauuauaaucagaacaaugagucucguaugagauugguggcuaugcucuacaccccacugaggucgaacggaucagccgaagacguauuuacaguuagcugccgggugcugaccaagcccagugcagauuucgaguuuaauuaucucgucccgccuacuguggagucccgcacaaaacccuucaccauuccaaucuuaacgauuggugaaaugacuaacucuagauuuccugugcccaucgacaugcugcacaccagcccaacagagaauaucgucguucaaccccagaacgggagguguacuauugauggcgaacuuuugggaaccacacagcugauaaccuccaauaucugcucauuccggggcaguauuagcggucaugaggggaacgacgaucagcaccuauggcacuucaauaucacgaacccuaauggaacuccauuugacccgacagaagaugugcccgcuccucucggcaccccagacuuccgcggccaacuguacgggguaauaucucagcgagacagagagggaacucccuccgagaacaaucagaaggccaacaggucacaugaaggugugauuagcacaaucaguccuaaauuugucccaaaacuuggcucugugaugaucgggaccuggacgaccgaugacauuaagaaucagcccuccaaguucacaccgaucggacugaacgaugacgauaacuuuaagcaaugggaguugccuaauuauagcggcgcgcucacucugaacauggguuuagccccaucgguuuuccccaccuacccuggggaacaggugcuguuuuuccggucuuaccuccccaugaaaggcggauauggcuccccauuuauugacugucuugucccucaggaguggguggcacacuucuaccaagaaucagcucccgcccagacagauguagcucugauacguuauguuaauccagagacugggcgcguguuguuugaggccaagcuacauagacagggauucaucaccgucgcaaaaaguggugacagcccgauuaacgugccugccaauggcuacuuuagguucgauuccugggucaaccaguucuauucucuggcucccauggggacaggaaauggccggcgacgcauccaauga

SEQ ID NO: 19889 - RNA, 1644 nt, Artificial Sequence
  derived and/or modified sequence opt3 from major_capsid_protein__Norovirus__AKF42429
augaagauggccagcaacgacgcugcacccuccaaugauggcgccgcgaaccuggugccugaggcuaccaaugaagucauggcccucgagccaguugugggggcaucuaucgccgcuccgguagugggacagcaaaacauuauagaccccuggaucagagaaaauuucguccaggcaccucagggugaguuuacagugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacugcgggaaaaauuaucuuugcagccgugcccccucauuucccaguagaaaauauuucugcugcccagaucacgaugugcccgcacguuauaguggauguccgccagcuugagcccgugcuguugccucucccagacauccgaaaccguuucuuucauuauaaucaggaaaacacccccagaaugaggcugguggcaaugcuguacacaccucuccgggcuaauucgggcgaggaugucuuuacuguuucaugucgcguguuaaccagaccagcccccgacuucgaguuuacauuccugguaccgccuaccguggaaagcaagacuaaacccuuuacacuuccaauuuugacccugggcgagcuaaguaacuccagguucccugcgcccaucgauaugcucuauacggacccaaacgaagccauugucgugcaaccccagaaugggcggugcacucuggauggaacccuucaggguacaacucagcugguuccuacccaaaucuguucuuuucgcggcacauugauaagccagaccucccgaucagcagacaguacggauagcgcuccaagagugaggaaccacccgcuccauguccagcugaagaauuuagacgggacucccuacgauccuacagacgaggugccagccguacugggagcuauugacuucaaaggcaccguuuucgguguggccucucaacggaacacuacaggaaauuccaucggggcaacccgugcccacgaaguccacauugauacgaccaacccccgcuauacaccuaagcucggcucagugcuuauguacagcgagaguacugacuuugaugacggccagccaaccagauucacacccaucgggaugggagcugaugacuggcaucagugggagcugccggaauacucuggucacuugacucuauccaugagccuggcgccugcagucgccccagcuuuucccggcgagaggauccucuucuuucggucggugguuccuucugccgggggauauggcuccggucauauugauugccugauaccccaggaaugggugcaacacuucuaccaggaggcagccccaucacagagugcuguagcccuuauccgauaugucaauccugacaccgggcgcaacauuuuugaagcaaagcugcacagagagggcuucaucacaguggcgaauagcggaaacaaucccauaguugugccaccgaacggcuacuuuagguucgaggcuugggucaaucaguuuuauaccuugacuccuauggggacgggacaaggucggcgcagagugcaguga

SEQ ID NO: 19890 - RNA, 1644 nt, Artificial Sequence
  derived and/or modified sequence opt3 from major_capsid_protein__Norovirus__AKF42434
augaagauggccagcaacgacgcugcacccuccaaugauggcgccgcgaaccuggugccugaggcuaccaaugaagucauggcccucgagccaguugugggggcaucuaucgccgcuccgguagugggacagcaaaacauuauagaccccuggaucagagaaaauuucguccaggcaccucagggugaguuuacagugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacugcgggaaaaauuaucuuugcagccgugcccccucauuucccaguagaaaauauuucugcugcccagaucacgaugugcccgcacguuauaguggauguccgccagcuugagcccgugcuguugccucucccagacauccgaaaccguuucuuucauuauaaucaggaaaacacccccagaaugaggcugguggcaaugcuguacacaccucuccgggcuaauucgggcgaggaugucuuuacuguuucaugucgcguguuaaccagaccagcccccgacuucgaguuuacauuccugguaccgccuaccguggaaagcaagacuaaacccuuuacacuuccaauuuugacccugggcgagcuaaguaacuccagguucccugcgcccaucgauaugcucuauacggacccaaacgaagccauugucgugcaaccccagaaugggcggugcacucuggauggaacccuucaggguacaacucagcugguuccuacccaaaucuguucuuuucgcggcacauugauaagccagaccucccgaucagcagacaguacggauagcgcuccaagagugaggaaccacccgcuccauguccagcugaagaauuuagacgggacucccuacgauccuacagacgaggugccagccguacugggagcuauugacuucaaaggcaccguuuucgguguggccucucaacggaacacuacaggaaauuccaucggggcaacccgugcccacgaaguccacauugauacgaccaacccccgcuauacaccuaagcucggcucagugcuuauguacagcgagaguucugacuuugaugacggccagccaacuagauucacccccaucgggaugggagcugaugacuggcaucagugggagcugccggaauacuccggucacuugacacuaaauaugaaccuggcgccugcagucgccccagcuuuucccggcgagaggauccucuucuuucggagcgugguuccuucggccgggggauauggcucuggucauauugauugccugauaccccaggaaugggugcaacacuucuaccaggaggcagccccaucccagucagcuguagcccuuauccgauaugucaauccugacacugggcgcaacauuuuugaagcaaagcugcacagagagggcuucaucaccguggcgaauaguggaaacaaucccauaguugugccaccgaacggcuacuuuagguucgaggcuugggucaaucaguuuuauacauugaccccuauggggacuggacaaggucggcgcagagugcaguga

SEQ ID NO: 19891 - RNA, 1650 nt, Artificial Sequence
  derived and/or modified sequence opt3 from major_capsid_protein__Norovirus__AKF42437
augaagauggccagcaccgacgcugcacccuccaacgauggcgccgcgaaucuggugccugaggcuaacaaugaagucauggcccucgagccaguugugggggcaucuaucgccgcuccgguagugggacagcaaaacauuauagaccccuggaucagagaaaauuucguccaggcaccucagggugaguuuacagugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacugcgggaaaaauuaucuuugcagccgugcccccucauuucccaguaaagaauauuucugcugcccagaucacgaugugcccgcacguuauaguggauguccgccagcuugaacccgugcuguugccucucccagacauccgaaaccguuucuuucauuauaaucaggaggauacccccagaaugaggcugguggcaaugcuguacacaccucuccgggcuaacucgggcgaagacgucuuuacuguuucaugucgcguguuaaccagaccagcccccgauuucgaguuuacauuccugguaccgccuaccguggagagcaaaacuaagcccuuuacacuuccaauuuugacccugggcgaacuaaguaauuccagguucccugcgcccaucgacaugcucuauacggauccaaacgagggggucgugguucaaccccagaacggacggugcacucuggacgguacccuucagggcacaacucagcuggugccuacccaaauuugugccuuucgcgggaaauugaucggacagacaucucgaagcccagauuccgacucaaccgauagugcaccgagaaggcgggaccacccccuccauguccagcuggaaaauuuagacggcacgcaauacgauccuacugacgaggugccagcuacacugggugccguagauuucaaggggaccauauucggaguugcuagccagcgugacacuucuggcucccaggugggcgccacacgcgcacacgaaguccacauuaacaccacggaucccagauauaccccuaagcucgggucaauccuuauguacagcgagagucuggacuuugagacaggacagccagugagguucacucccauugguaugggcgaaaaugauuggcaucaaugggaguugccggacuacucugggcggcuaacccugaacaugaaucucgccccugcugucgcgccagcauuucccggagaacgaauccuguucuuucgcuccaucgugccuagcgccggcgguuaugggucgggccagauugauugccuuauaccccaggaguggguucagcacuucuaccaagaagcugccccaucucaguccgcaguggcccugaucagauauguaaacccugacacaggaaggaauauuuuugaggcuaaauugcaucgggagggcuucaucacugucgccaacucagggaauaaccccauagugguuccaccgaauggauacuuucgcuucgaagcaugggugaaccaguuuuauacccucacaccuauggguaccggccaggggagaaggcguaaucaauga

SEQ ID NO: 19892 - RNA, 1623 nt, Artificial Sequence; identical to SEQ ID NO: 18112
  derived and/or modified sequence opt3 from major_capsid_protein__Norovirus__ALA27427

SEQ ID NO: 19893 - RNA, 1623 nt, Artificial Sequence
  derived and/or modified sequence opt3 from major_capsid_protein__Norovirus__ALD09618
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugaugcacgaaacaccuucuuucacuauuccaaucagccaaacucucguaugagacugguagcuaugcuuuacacacccuugaggucgaacgggucaggagacgauguuuucaccgugagcugccggguccugacucgcccgacaccugacuuugaguucaccuaucuagugcccccaaguguggaauccaagacgaaaccuuuuucucuccccauucugacucuuagcgagcugaccaauuccagauucccaguccccaucgauucauuguuuacagcccaaaacaauguucuccaggugcagugucagaacgguaggugcacucuggacggcgaguuacaagggaccacacagcugcucccuaguggaauuugugcguuccggggccgcguaaccgcccagaucaaucagcgagauagauggcauaugcaacuucagaaccugaaugguacgacuuacgacccaacagaugacgugccggcacccuuggggaccccugacuucaagggagucguguuuggcaugguuagccagaggaacgugggcaaugaugcuccagggucuacucgggcccaacaggcuugggucuccacauauucaccccaguucgugccuaaacuaggaagcguaaaccugcguauaagugacaaugaugacuuucaguuccaaccaaccaaguuuacgcccguuggugugaacgaugacgaugacggccacccguuccgccagugggaacucccuaauuacucuggggagcugacccuuaacaugaaucuggccccacccgucgcaccuaacuuucccggagaacagcucuuguucuuuagauccuucgugccaugcagcggcgguuacaaccaggggauuaucgauugucugauuccucaagaguggauccagcauuuuuaucaggaaucggcccccucucaguccgacgucgcuuuaaucagguacgugaauccagauacaggccggacucuguucgaggcgaagcuacaccgaucaggauauauuaccguugcacacaguggcgacuacccgcucgugguaccugccaacgggcauuuucgcuucgacagcugggucaaucaauucuauucccuggcucccaugggaacagguaacggcagaaggcgggcccaguga

SEQ ID NO: 19894 - RNA, 1623 nt, Artificial Sequence
  derived and/or modified sequence opt3 from major_capsid_protein__Norovirus__ALM96644
augaagauggccagcuccgacgcuaaccccucugauggcucaaccgcaaaucugaucccugaggugaacaaugaagucauggcccucgagccaguugugggggcggcuauugccgcaccgguagccggacagcaaaacgugauagaccccuggaucagaaauaacuucguccaggcuccugguggcgaauuuacagugaguccaaggaaugcacccggggagauucuuuggagcgccccucugggaccagauuugaaccccuacuuaucccaccuggcucggauguauaauggcuacgccgguggguucgaaguucaggugauccuagcgggaaacgcauuuacugccggcaaaauuaucuucgcugccgucccuccaaauuuuccgacggagggccucucucccucacaggugaccauguucccucauauaaucguagacguucgccaacuggagccagugcuuauuccccugccugauguccgaaacaauuuuuaucacuacaaccagucgaaugacagcacaaucaaguugauugcaaugcucuauacuccacugcgugcuaacaacgccggggaugacaucuucaccgugaguugcagagugcugacaaggcccuccccggauuuugacuucauauuucucgucccucccaccguugaaucucggacuaaaccauucagcgugccuguauuaacaguggaggaaaugaccaauucccgcuuucccauuccacuggagaaacuuuucacgggacccucaagugcguuggucgugcagccucagaacgguagauguacuaccgauggcguucugcuagggacaacucaacucagcccagugaauaucugcaccuucaggggagacgucacacauauuccgggcucucggaacuacaccaugaaucuggccucccagaacuggaacucauaugaucccacggaggaaaucccugcaccacuugguacucccgacuuuguggggaagauccagggaguacugacacagaccacucgcacaaauggcagcacccgaggccacaaggcuacgguuuacaccgggagugccgacuucucuccuaaguugggaagagugcaauuugcuacagauacugacaaugauuucgagaccaaccagaauacaaaauuuacuccagucggugugauucaggacggcuccaccacacccaggaacgaaccgcaacaguggguccucccuagcuacucggggcggaauauacauaacgugcaccuggccccagcaguugcccccaccuucccuggagagcaguuacuguuuuuccguucuacuaugcccggcuguuccgguuauccaaauauggaucucgacugccuucugccucaggaaugggugcaauacuuuuaucaggaggcugcgcccgcacagucagauguagccuugcuacgcuucgucaacccagacacggggagagugcuguuugaguguaagcuccacaaaaguggcuacguuacaguggcucauaccggacagcacgaucuggucaucccgccuaacggcuauuucagguuugacagcugggugaaucaauucuacacucuugcccccauggggaacggaaccggucggcgacgcgcacuguga

SEQ ID NO: 19895 - RNA, 1623 nt, Artificial Sequence
  derived and/or modified sequence opt3 from major_capsid_protein__Norovirus__ALM96645
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccgggggagauguguucaccgucaguugcagaguucugacaaggcccuccccggacuuugauuucauuuuucucgugccucccaccguagaaucucggacuaaaccauucagcgugccugucuuaacaguggaggaaaugaccaauucccgcuuucccaucccacuggagaaacuuuucacgggucccucaagugcguucguugugcagccucagaacggcagauguacuaccgacggggucuugcugggaacaacucaacuaagcccagugaauauaugcaccuuuaggggcgauguaacacauauuccggguucucggaacuacaccaugaaucucgccucccagaacuggaacucauaugaccccacggaggaaaucccugcaccacuggggacucccgauuucguuggaaaggugcagggcguccuuacacagaccacucgcacaaauggcagcacccgagggcacaaggcuacgguguacaccggaagugccgacuuuucuccuaagcuggguagaguccaauucgcuacagacacugauaaugacuuugagaccaaccagaauacaaaauucacuccagugggcguuauucaggauggguccaccacacccaggaacgaaccgcaacaguggguguugccuagcuacucgggacggaauauccauaacguacaccucgccccagcagucgcccccaccuuuccuggcgagcagcuguuauucuuucguucuacuaugcccgguuguuccggguauccaaauauggaccuggauugccuccuuccucaggaaugggugcaauacuucuaucaggaggcugcgcccgcacagucagacguugcccuguugcgcuuugugaacccagauacggucagagugcuauucgaguguaagcugcacaaaaguggcuacguaacaguggcucauaccggacagcacgaccucguuaucccgccuaacggcuauuuuagguucgauagcugggucaaucaauucuacacucuggcccccauggggaacggaaccggucggcgacgcgcacuuuga

SEQ ID NO: 19896 - RNA, 1623 nt, Artificial Sequence
  derived and/or modified sequence opt3 from major_capsid_protein__Norovirus__ALM96646
augaagauggccagcaacgacgcuaaucccuccgauggcucugcagccaaccuggugccuaaagucaauaacgagguuauggcgcucgaaccagugguaggggcugccaucgcagccccgguggcuggacagcaaaaugucauugaccccuggauaaagaacaauuucgugcaggcaccugguggcaaauuuaccguuucaccaaagaacgcccccggggagauccuuuggagugcuccucugggaccagauuugaaucccuacuuaagccaccuggccagaauguauaaaggccaugcggguggguucgaagugcaggucauucuagcaggaaacgccuuuacagcuggcaagaucauuuucgccgcagugccuccaaauuuuccgacugagggccucucccccucucagguaacgauguucccucacaucauaguugacgugaggcaacuggaaccaguccuuaucccccugccugaugugcggaacaauuuuuaccauuauaaccagucgaaugacucaaccauuaaguugaucgcuaugcucuacacaccacugcgcgccaacaacgcgggggaggauguguucacugucagcugccgaguucugacccgucccaguccggacuuugauuucauuuuucucgugccucccacaguagaguccagaaccaaaccauucacugugccuaucuuaacagucgaagagaugaccaauucuagguuucccauaccacuggaaaaacuuuucacgggacccagcuccgccuucgugguucagccucagaacggucgguguacuaccgacggcguguugcuggggacaacucaacuaucaccagucaauauuugcaccuuucgcggagaugugacacacaucgcaggcaguagaaacuauaccaugaaucucgcuagccugaacuggaauaacuacgacccgacggaggagauucccgccccucuugguacuccagauuucguagggaagauccagggaguucugacacagaccacuaagggcgacggcucuacaagggggcauaaagcuaccguguauacgggauccgcccccuuuaccccuaaguuggguucaguccaguucagcacagacacugaaaaugauuuugagacccaccaaaacacaaaguucacuccagugggcgucauccaggacgggggaaccacacaccggaaugaaccccagcaaugggugcucccgaguuacucuggccgcaacguuccuaaugugcaucuggcaccagccguagcucccaccuuuccuggugagcaguuacuguucuuucgauccacuaugcccggguguagcggcuacccaaacauggaucucgacugccuucugccucaggaauggguccagcacuucuaucaagaggcggcacccgcccagucggauguggcuuugcuaagauuuguuaauccagacacgggaagggugcuguucgaguguaaacuccauaagucuggcuacgucacaguggcccacaccgggcagcacgaucugguaauuccgccuaacggauauuuucgguucgacuccugggugaaccaguucuacacucuugcacccauggguaauggcaccgggcgucgcagagcccuguga

SEQ ID NO: 19897 - RNA, 1623 nt, Artificial Sequence
  derived and/or modified sequence opt3 from major_capsid_protein__Norovirus__ALM96647
augaagauggccagcaacgacgcuaaucccuccgauggcucugcagccaaccuggugccuaaagucaauaacgagguuauggcgcucgaaccagugguaggggcugccaucgcagccccgguggcuggacagcaaaaugucauugaccccuggauaagaaacaauuucgugcaggcaccugguggcaaguuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggaaccaguccuuaucccccugccugaugugcgaaauaacuuuuaucacuacaaucagucgaacgacucaaccauuaaguugaucgcuaugcucuauacaccacugcgugccaacaaugcgggggaggauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggaaaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaggagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaggcaccacacaccgaaacgaaccccagcaaugggugcucccgagcuacagugguagaaauguucacaacgugcaucuggccccugcaguagcuccaaccuuucccggggagcaguuacuguucuuuaggucuacuaugccuggcuguuccggauaucccaauauggaucucgacugccuucugccacaggaauggguccagcacuucuaccaagaggcggccccugcacagagcgauguggcuuugcuacgguuuguuaaccccgacacgggccgugugcuguucgaguguaaacuccauaagucgggguaugucacaguggcccacaccggacagcacgaucugguaauuccaccgaacgguuacuuucgcuucgacucuugggugaaucaguucuauacucuugcaccuaugggcaacgggaccggaagaaggcgggcccuguga

SEQ ID NO: 19898 - RNA, 1623 nt, Artificial Sequence; identical to SEQ ID NO: 18640
  derived and/or modified sequence opt3 from major_capsid_protein__Norovirus__ALM98891

SEQ ID NO: 19899 - RNA, 1623 nt, Artificial Sequence; identical to SEQ ID NO: 18640
  derived and/or modified sequence opt3 from major_capsid_protein__Norovirus__ALM98892

SEQ ID NO: 19900 - RNA, 1623 nt, Artificial Sequence; identical to SEQ ID NO: 18640
  derived and/or modified sequence opt3 from major_capsid_protein__Norovirus__ALM98893

SEQ ID NO: 19901 - RNA, 1623 nt, Artificial Sequence; identical to SEQ ID NO: 18640
  derived and/or modified sequence opt3 from major_capsid_protein__Norovirus__ALM98894

SEQ ID NO: 19902 - RNA, 1623 nt, Artificial Sequence; identical to SEQ ID NO: 18640
  derived and/or modified sequence opt3 from major_capsid_protein__Norovirus__ALM98895

SEQ ID NO: 19903 - RNA, 1623 nt, Artificial Sequence; identical to SEQ ID NO: 17999
  derived and/or modified sequence opt3 from major_capsid_protein__Norovirus__ALM98896

SEQ ID NO: 19904 - RNA, 1623 nt, Artificial Sequence; identical to SEQ ID NO: 18640
  derived and/or modified sequence opt3 from major_capsid_protein__Norovirus__ALM98897

SEQ ID NO: 19905 - RNA, 1623 nt, Artificial Sequence; identical to SEQ ID NO: 18640
  derived and/or modified sequence opt3 from major_capsid_protein__Norovirus__ALM98899

SEQ ID NO: 19906 - RNA, 1623 nt, Artificial Sequence; identical to SEQ ID NO: 18317
  derived and/or modified sequence opt3 from major_capsid_protein__Norovirus__ALM98901

SEQ ID NO: 19907 - RNA, 1623 nt, Artificial Sequence
  derived and/or modified sequence opt3 from major_capsid_protein__Norovirus__ALM98907
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcgggacuacccaucggaacgagccccaacaguggguauugccgaguuacucuggacguaauauuccuaacguccaccucgccccagcuguggcgcccacauuuccuggcgaacagcuguuauucuuucgcuccaccaugcccgguuguagcggguauccaaauauggaccuggauugccuccuuccucaggaguggguucaauacuucuaucaggaggcagcccccgcucagucggacguggcccuguugagauuugucaacccagauacuggcagggugcuauucgaauguaagcugcacaaaucuggauacguaacgguggcacauacaggccagcacgaccucguuaucccgccuaauggguauuuucgguucgauuccugggucaaccaauucuacacccuggcccccaugggaaacgguacuggccgacgcagagcucuuuga

SEQ ID NO: 19908 - RNA, 1623 nt, Artificial Sequence
  derived and/or modified sequence opt3 from major_capsid_protein__Norovirus__ALM98910
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggaccuggauugccuccuuccucaggaguggguucaauacuucuaucaggacgcagcccccgcucagucggauguggcccuguugcgcuuugucaacccagacacgggcagagugcuauucgaguguaagcugcauaaaucuggauacguaacaguggcacacaccggccagcaugaucucguuauuccgccuaauggguauuuuagguucgacuccugggucaaccaauucuacacucuggcccccaugggaaacgguaccggccggcgacgcgcucuuuga

SEQ ID NO: 19909 - RNA, 1623 nt, Artificial Sequence
  derived and/or modified sequence opt3 from major_capsid_protein__Norovirus__ALM98913
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacugauagagacuuugaagcaaaccagaauaccaaauucacaccaguuggugugauccaggauggcgggacuacccacaggaacgagccccaacaguggguauugccgaguuacucuggacgguccacaccuaauguccaccucgccccagcuguggcgcccaccuuuccuggcgaacagcuguuauucuuucguagcacuaugcccgguuguucgggguauccaaacauggaccuggauugccuccuuccucaggaguggguucaauacuucuaucaggaggcagcccccgcucagucugacguggcccuguugcgcuuugucaauccagauacgggcagagugcuauucgaauguaagcugcauaaauccggauacguaacaguggcacacaccggccagcaugaccucguuauuccgccuaacggguauuuuagguucgauucaugggucaaucaauucuacacucuggcccccaugggaaacgguaccggccggcgacgcgcucuuuga

SEQ ID NO: 19910 - RNA, 1623 nt, Artificial Sequence; identical to SEQ ID NO: 18508
  derived and/or modified sequence opt3 from major_capsid_protein__Norovirus__ALM98916

SEQ ID NO: 19911 - RNA, 1623 nt, Artificial Sequence
  derived and/or modified sequence opt3 from major_capsid_protein__Norovirus__ALT54478
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcgccgacggcucaacacgaggccacaaggcuaccgucuacacggggagcgccgauuuugcaccuaagcugggaagagugcaauucgagaccgacacagaucaugacuuugaagccaaccagaauacuaaauucaccccaguuggugugauccaggauggcgggacaacucacaggaacgagccccaacaguggguauugccgaguuacucuggacggaauaccccuaacguccaccucgcuccagcgguggcacccacauuuccuggcgaacagcuguuauucuuucguuccaccaugcccgguuguagcggguauccaaauauggaccuggauugccuccuuccucaggaguggguucaauacuucuaucaggaggccgcucccgcccagucggacguggcacuguugcgcuuugucaacccagauacuggcagagugcuauucgaauguaagcugcauaaaucuggauacguaacgguggcccacacaggccagcaugaccucguuauuccgccuaauggguauuuuagguucgauuccugggucaaccaauucuacacccuggcucccaugggaaacgguacuggccggcgacgcgcccuuuga

SEQ ID NO: 19912 - RNA, 1617 nt, Artificial Sequence
  derived and/or modified sequence opt3 from major_capsid_protein__Norovirus__ALT54488
augaugauggccagcaaggacgcucccuccaacauggauggcaccucuggggcaggacagcuggugccugaagucaaugccgcggaaccacucccgcuugagcccguugugggugcugccacagcagccgcuacugcaggccaaguaaacaugaucgacccuuggauuaugaauaacuucgugcaggccccagaaggggaguuuacgauaucacccaauaacaccccuggagauauccuguucgacuugagauuaggcccacaccugaaucccuuucuacuccaucugagucagauguacaacgguugggucgggaauaugagggugcggguuaugcuugcuggaaacgccuucagcgcgggcaaaauuaucauuugcugugugccuccaggcuuugaaucccagaauaucucuauagggcaagcaacaauguucccgcacgucaucgccgaugugcgcguacuggagcccauugagguuccuuuggacgaugugcgaaacguccucuuucauacuaaugaaaaccguccaaccaugagacugcugugcaugcucuauacacccuuaagggcuggaggugccucgucaggcaccgacccuuucgugaucgcagggcgggugcugacuuguccagcucccgauuuuaauuuccuuuucuuggucccgccuagcguugagcagaagacacgccagcugaccauucccaacaucccacuaaacaaucucgccaacaguagagugccugcgaugauaaauaaaaugacgguauccgccgaccagaaccaagugguccaguuccagaauggaaggugcacucuggaaggccagcuucuggguaccacacccgugucugcaaaccaaguugcucggauucgcgggaagguguuuagcacuaauuccggaaccggcuugaaccucacagaggucgauggcaccccauaccacgccuucgagucacccgcuccucugggguucccagacaucggaaauugugauuggcauguguaugccuuuaaaguaaaccagaauacgggugacccgauguaccgauuagacauuacucagggcaacaguuucgcaccccaccuggggagcaucgaauuuucuuccgagaaucacccuucaggagaucaacucggcacacuuaccuggaucagcccacugaacaaugccaguagaguugaccccuggaagauuccuacuuaugguucuacauugaccgaauccacgaaccuagcuccacccauauucccgccuggguuuggcgagagcaucguguacuucaugucggauuuuccaauugucucuggaaacaccgcgcagauccccugcacacugccucaggaauuuguguccucauuugucgagcagcaagcacccauaaggggcgaggccgcucuccugcauuauguggacccagauacucaccggaaucuuggggaguucaagcuguacccugacggauuuauuaccuguguucccaacacagguggcgggccacagaauuugccgaguaacggaguguucguauuuagcuccugggucucucguuacuaucagcucaaaccugugggcacuaccggucccguucgcagacugggggugaggcgggucuga

SEQ ID NO: 19913 - RNA, 1620 nt, Artificial Sequence
  derived and/or modified sequence opt3 from major_capsid_protein__Norovirus__ALT54491
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaggacagcaccauuaaauugaucgcuaugcucuauacaccacugcgugccaauaacgcgggggaugacguguucacugucaguugcagaguucugaccaggcccuccccggauuuugacuucauuuuucucgugccucccacaguagaaucucggaccaagccauucacugugccuaucuuaacagucgaggaaaugaccaacagccgcuuucccauaccacuggagaaacuuuucacgggacccuccaaugccuucgugguucagccucagaacgguagauguacuaccgauggcguguugcuggggacaacucaacuaucaccagucaauauuugcaccuuuaggggagacgugacacagaucgcaaguacccagacguacacuaugaaccucgcuagccugaauuggaacaauuaugauccgacagaggaaauucccgccccucuuggcgcuccagacuucauggguaagauccaggggguacugacccaaacuacacggcagggaggcucuacccgcggccauaaggccacgguuuccaccgggucagugcacuuuacacccaaauugggaagcguccgauucgacacugauaccaacaaugaccuccagccucaucaaaguacaagauuuacuccagugggugucauccaggauggcgacacccaccagaacgagccccagcaaugggcacugccguguuacucugggagggaugugaauaacguucacuuagccccugcuguggcgccauccuuccccggagaacagcugcucuuuuuccggagcacaaugccuggcugcucggguuaccccaauauggaccuugauugucuguugccacaggaguggguacagcauuuuuaucaagaagcagccccugcucagucugacgucgcccuacugcguuucgugaaccccgauaccgggcgcguucucuuugagugcaagcugcacaaauccggcuacgugacugucgcacauacgggacagcacaaucuugugauuccaccgaacggcuauuucagauuugacucauggguaaaccaguucuacacacuggccccuauggggaauggaaccgguaggcggcgaguguuguga

SEQ ID NO: 19914 - RNA, 1620 nt, Artificial Sequence
  derived and/or modified sequence opt3 from major_capsid_protein__Norovirus__ALT54494
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaggacagcaccauuaaauugaucgcuaugcucuauacaccacugcgugccaauaacgcgggggaugacguguucacugucaguugcagaguucugaccaggcccuccccggauuuugacuucauuuuucucgugccucccacaguagaaucucggaccaagccauucacugugccuaucuuaacagucgaggaaaugaccaacagccgcuuucccauaccacuggagaaacuuuucacgggacccuccaaugccuucgugguucagccucagaacgguagauguacuaccgauggcguguugcuggggacaacucaacuaucaccagucaauauuugcaccuuuaggggagacgugacacagaucgcaaguacccagacguacacuaugaaccucgcuagccugaauuggaacaauuaugauccgacagaggaaauucccgccccucuuggcgcuccagacuucauggguaagauccaggggguacugacccaaacuacacggcaggacggaucuacccgcggccauaaggccacgguuuccaccggcucagugcacuuuacacccaaauuggggagcguccgauucgauacugacaccaacaauaaccuccagccucaucaaaguacaagauuuacuccagugggagucauccaggauggugacacccaccagaaugagccccagcaaugggugcugccguguuacucuggcagggauguuaacaaugugcacuuagccccugcaguagcuccauccuuccccggggaacagcugcucuuuuuccggagcacaaugccuggaugcucgggcuaccccaacauggaccuugauugucuguugccacaggaguggguccagcauuuuuaucaagaagcggccccugcacagucugacguggcucuacugcguuucguuaaucccgauaccggucgcgugcucuuugagugcaagcugcacaaauccggguacgucacuguggcccauacgggccagcacaaccuuguaauuccaccgaacggauauuucagauuugacucaugggugaaucaguucuacacacuggcaccuaugggcaacgggaccggaaggcggcgaguuuuguga

SEQ ID NO: 19915 - RNA, 1620 nt, Artificial Sequence
  derived and/or modified sequence opt3 from major_capsid_protein__Norovirus__BAM65003
augaugauggccagcaaggacgcucccuccaacauggauggcaccucuggggcaggacagcuggugccugaggucaaugccgcggaaccacucccgcuugagcccguugugggugcugccacagcagccgcuacugcaggccaaguaaaccugaucgacccuuggauuaugaauaacuucgugcaggccccagaaggggaguuuacgauaucacccaauaacaccccuggagauaucuuguucgacuuacagcugggcccacaccuaaaucccuuucuccagcaucugagucaaauguacaacgguugggucgggaauaugagagugaggguuaugcuugcuggaaacgccuucacagcgggcaaaauuaucauuugcugugugccuccaggcuuugcaagccagaauaucuccauagggcaggccacuauguucccgcacgucaucgcugaugugcggguacuggaacccauugagaucccuuuggacgauguucgcaacgugcucuuucauaccaaugagaaccgaccaacaaugcgucugcugugcaugcucuauacccccuuaagagccggaggugcaucuucgggcacugacccuuucgucauugcugggagggugcugacauguccaucacccgauuuuaauuucuuguuucuugugccgccuagcgucgaacagaagacccggcaacugacgguucccaacaucccacuaaacaaucucgccaacagucgcgugccugcgaugauaaauaaaaugacuguauccaccgaccagaaccaggugguccaguuccaaaauggaagaugcacacuggagggccagcuucuggguacuacccccgugucugccagccagguugcaaggauucgggggaagguguuuuccacagcuucaggaaaaggcuugaaccucaccgaacuggauggcacgccauaccacgccuucgagagucccgcuccuuuaggguucccagacaucggagccugugauuggcaugucagcacuuuuaagguggaccaaaaucugucuggugacccgaugucccgccucgauauuaagcagaacgcacccuucgccccucaccuuggcucaaucgaguuuacaagcgaccaggaaccaaccggggaucagcugggaacuuuggcuuggguaagucccucuacauccggcgcgcgaguugacccuuggaaaaucccaagcuaugguucgaccgugacggagucuacccaccuagcacccccgauuuucccuccaggguuuggcgaagccauagucuacuucauguccgauuuucccaucgugucaggaaauacagcucaagucccuugcacucugccccaggaguucgugagucauuuuguugaacagcaggccccaauuagaggcgaggcagcccuccugcacuauguggacccugauacccauaggaaccuuggggaguucaagcuguaccccgacggauuuaucacauguguaccaaauacugguggcgggccgcaaaacuugccuauaaauggagucuucguguuuagcuccuggguuucucgguauuaccagcucaaacccgugggcaccgcugguccagcccgucgccugggggucagaaggguguga

SEQ ID NO: 19916 - RNA, 1647 nt, Artificial Sequence
  derived and/or modified sequence opt3 from major_capsid_protein__Norovirus__BAM65005
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgacaaucuuagugccgcgcagauuacgaugugcccgcauguuaucguggauguccggcaacuggagcccgugaacuugccuaugccagacguacgcaauaacuucuuucacuauaaccaggggagcgauucccgacuccgucugauugccaugcuguacacuccccucagagcaaauaacucuggagacgauguuuucacagugucguguagggucuuaacucggccuucaccagacuuuagcuucaauuuucuggugcccccgaccguggaaaguaagacaaaaccuuucacccuucccaucuugacuauauccgagaugucuaacagccgcuuuccagucccuauugauucccugcauacaucacccaccgaaaauaucguugugcagugccagaacgguagaguaacgcuagacggcgagcucauggggacuacccaacugcuuccaagucagauuugugcuuucaggggagugcugacacggagcacuucucgcgccuccgaucaggcugacaccgccacaccccgauuguucaauuauuacuggcacauccagcucgacaaccugaauggcaccccuuaugauccagcagaggacaucccgggucccuuagggacgccugauuuuagaggaaaggucuucggcguggccucacaaaggaacccagacagcacuacacgggcucaugaagcgaaaguugauaccaccaguggccguuuuacacccaagcuggggucucucgagauuuccaccgaaagcggagacuucgaucagaaucagccuacgcgcuuuaccccaguggguauaggcgucgacaacgaggcagauuuccaacaguggucgcuucccgacuacucugggcaguuuacacacaauaugaaccuggccccggcuguggccccuaauuucccaggagaacaguugcuauuuuucagaucccaacugcccucaaguggcgguaggagcaacgggauccucgauugccugguaccucaggaguggguucagcacuuuuaccaggaguccgcacccgcccaaacucagguggcucuuguccgguaugugaacccagacaccggccgaguccuguucgaagccaaguugcauaaacucggauuuaugacaauugcaaagucuggcgacagcccuaucacugugcccccaaauggguacuuccgcuucgagucauggguuaacccguuuuauacccuggcgccuaugggaacagguaauggcagaaggcggauacaguga

SEQ ID NO: 19917 - RNA, 1644 nt, Artificial Sequence
  derived and/or modified sequence opt3 from major_capsid_protein__Norovirus__BAM65007
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcgcccaucgauaugcucuauaccgacccaaaugaagggauugucgugcaaccccagaacggacggugcacgcuggaugguacucuucagggcaccacacagcugguuccuacucaaaucugugccuuucgcgggaccuugauaggacagacaucucgaagcuccgacucaaccgauagugcaccaagaaggcgggaccacccgcuccaugugcagcugaagaauuuagauggcacgcaauacgaccccacugacgaggucccugcugugcugggugccauugauuucaaagggacaguauucggaguugcuagccagcgugacgugucuggccagcaggucggcgccacccgcgcacacgaagugcacaucaacacuacagauccaagauauacccccaagcucggguccauucuuaugcauucagagagcgacgauuuugucacgggacaaccugugagguucaccccaaucgguaugggcgacaaugauuggcaccagugggagcugcccgacuacagugggcauuugacacuaaacaugaaucuggccccggcuguugcgccugcauuuccaggagaacggauccucuucuuucgaucuauugugcccuccgccggcgguuacgggagcggccagauagauugccugaucccucaggaguggguacaacacuucuaucaggaagcugcccccucgcagucugcagucgcccuuauucgcuacgugaacccagacacuggaagaaauaucuuugaggcuaagcugcacagggaaggcuucauaaccguugccaacuccgggaauaacccuauuguggugcccccaaauggauauuuucgguucgaggcaugggucaaccaguuuuacacauugacuccgauggguaccggccaagggcgcagaaggaaucaguga

SEQ ID NO: 19918 - RNA, 1623 nt, Artificial Sequence; identical to SEQ ID NO: 17662
  derived and/or modified sequence opt3 from major_capsid_protein__Norovirus__CCX28604

SEQ ID NO: 19919 - RNA, 1623 nt, Artificial Sequence
  derived and/or modified sequence opt3 from major_capsid_protein__Norovirus__CCX28607
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacauuauagaccccuggaucagaaauaacuucguccaggcuccugguggcgaauuuacagugaguccaaggaaugcacccggggagauucuuuggagcgccccucugggaccagauuugaaccccuacuuaucccaccuggcucggauguauaauggcuacgccgguggguucgaaguucaggugauccuagcgggaaacgcauuuacugccggcaaaauuaucuucgcugccgucccuccaaauuuuccgacggagggccucucucccucacaggugaccauguucccucauauaaucguagacguucgccaacuggagccagugcuugucccccugccugaugugcgaaacaauuuuuaucacuacaaccagucgaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccggaacuacaccaugaaucucgcaucucagaacuggaacuccuaugaucccacggaggaaauuccugcuccacuggguacucccgacuucguagggaagauccagggaguucuuacacagaccacucgcacagacggcucaacccgaggccacaaggccacgguguacaccgggagcgcugauuuuaguccuaagcugggaagaguccaauucgccacagacacugauaaugacuuugaggcaaaucagaacaccaaauucacaccagugggugucauccaggauggcucuacugcccauaggaaugaaccccaacaguggguguugccguccuacagcgggcggaacauucacaauguucaccucgcuccugcgguggcaccaaccuuucccggagagcagcuguuauucuuucguucgacaaugccuggcuguucugguuaucccaacauggaccuggauugccuccuuccacaggaauggguacaauacuucuaucaggaggccgcuccugcccaguccgacgucgcacuguugcgcuuugugaaucccgauaccgggagaguucuauucgaguguaagcugcauaaaccaggcuacgugacugucgcccacacgggacagcaugaccucgugauaccgccuaacggcuauuuuagguucgauucauggguaaaccaauucuacacacuggcucccauggggaauggaaccggucggcgacgcgcccuuuga

SEQ ID NO: 19920 - RNA, 1623 nt, Artificial Sequence
  derived and/or modified sequence opt3 from major_capsid_protein__Norovirus__CCX28619
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauauccccggcagccacaacuacaccaugaaucucgccucucagaacuggaacuccuaugauccuacggaggaaauuccagcaccccuggguacuccugacuucguagggaagauccagggaguucuuacacagaccacucggacaaauggcucaacccgcggccauaaggcuacgguguacaccgggagcgccgacuuuaguccaaagcugggacgaguccaauucgcuacagauacugacaaugauuuugagaccaaccagaauacaaaauucacucccgugggugucauccaggacggcucuaccacaccgagaaacgaaccucaacaguggguguugccauccuacagcgggaggaauauucacaacguucaccucgcccccgcaguggccccuaccuuucccggagagcagcuguuauucuuucggucgacuaugccaggcuguucugguuauccuaauauggaucuggacugccuccuuccccaggaauggguacaauacuucuaucaggaggcugcgccagcacaguccgaugucgcccuguugcguuuugugaacccggacacggggcgcguucuauucgaguguaagcugcauaaaucaggcuacgugacagucgcucacaccggacagcaugaucucgugauaccucccaacggcuauuuuagauucgacaguuggguaaaucaauucuacacucuggccccaauggggaacggaaccgguaggcggcgagcacuuuga

SEQ ID NO: 19921 - RNA, 1623 nt, Artificial Sequence
  derived and/or modified sequence opt3 from major_capsid_protein__Norovirus__CCX28622
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauuucuggcucccggaauuacaccaugaaccucgccgcacagaauuggaacucauaugaucccacggaggaaaucccugcuccacuggguacucccgacuucguugggaagauucagggagugcuuacacagaccacuaagacaaauggcagcacccgcggccacaaggccacggucuacaccgggagugcugacuuuucuccuaaacugggacgagugcaauucgccacagauacugacaacgauuuugagaccaaucagaacacaaaguucacuccagucggugugauccaggacggcuccaccacacccagaaaugaaccgcaacaguggguuuugccuagcuacucggggaggaacacccauaaugugcaccucgcaccagccguagcucccacuuuuccuggagagcagcuguuauucuuucggucuacgaugcccggcuguuccgguuauccaaacauggaucuggacugccuccuuccucaggaauggguccaauacuucuaucaggaggcggcacccgcccagucagauguggcucuguugcguuuuguuaauccagacacagggcgcgugcuauucgaguguaaacugcacaagaguggcuacgucaccguggcccauacuggacagcacgaucucguaaucccgccuaacggcuauuuuagauucgacagcugggugaaccaauucuacacccuggcacccauggggaauggaacagguaggcggcgagcccuuuga

SEQ ID NO: 19922 - RNA, 1623 nt, Artificial Sequence; identical to SEQ ID NO: 19920
  derived and/or modified sequence opt3 from major_capsid_protein__Norovirus__CCX28625

SEQ ID NO: 19923 - RNA, 1623 nt, Artificial Sequence; identical to SEQ ID NO: 19921
  derived and/or modified sequence opt3 from major_capsid_protein__Norovirus__CCX28628

SEQ ID NO: 19924 - RNA, 1623 nt, Artificial Sequence; identical to SEQ ID NO: 17662
  derived and/or modified sequence opt3 from major_capsid_protein__Norovirus__CCX28631

SEQ ID NO: 19925 - RNA, 1623 nt, Artificial Sequence; identical to SEQ ID NO: 19920
  derived and/or modified sequence opt3 from major_capsid_protein__Norovirus__CCX28634

SEQ ID NO: 19926 - RNA, 1623 nt, Artificial Sequence
  derived and/or modified sequence opt3 from major_capsid_protein__Norovirus__CCX28637
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacaguacaauuaaguugaucgcaaugcucuauacuccacugcgugcuaauaacgccggggaugacguguucaccgucuccugcagaguucugacaaggcccucuccggauuuugacuucauuuuucucgugccucccaccguagaaagccggacuaaaccauucuccgugccugucuuaacaguggaggaaaugaccaacucacgcuuucccaucccacuggagaaacuuuucacgggacccaguagcgcguucguugugcagccucagaaugguagauguacuaccgauggcgucuugcuggggacaacucaacuaucuccagugaacauaugcaccuuuaggggagacguaacacauauuuccggcucacggaauuacaccaugaaccucgccagccagaauuggaacaguuaugauccgacggaggaaauccccgcaccucuggguacuccagacuucguugggaagauucagggagugcuuacacagaccacuaagacaaauggcucuacccgcggccacaaggcuacggucuacaccggguccgccgacuuuagccccaaacugggacgagugcaauucgcuacagauacugacaacgauuuugagaccaaucagaacacaaaguucacuccugucggugugauccaggacggcucgaccacaccaagaaaugaaccccaacaguggguuuugccgucuuacuccgggaggaacacccauaaugugcaccucgccccugcaguagccccaacuuuucccggagagcagcuguuauucuuucggucaacgaugccuggcuguagugguuaucccaacauggaucuggacugccuccuuccacaggaauggguccaauacuucuaucaggaggcugcgccugcacagagcgauguggcccuguugcguuuuguuaaucccgacacagggcgcgugcuauucgaguguaaacugcacaaguccggcuacgucaccguggcucauacuggacagcacgaucucguaaucccaccgaacggcuauuuuagauucgacucuugggugaaccaauucuacacccuggccccuauggggaauggaacagguaggcggcgagcacuuuga

SEQ ID NO: 19927 - RNA, 1623 nt, Artificial Sequence; identical to SEQ ID NO: 17662
  derived and/or modified sequence opt3 from major_capsid_protein__Norovirus__CCX28640

SEQ ID NO: 19928 - RNA, 1623 nt, Artificial Sequence; identical to SEQ ID NO: 19920
  derived and/or modified sequence opt3 from major_capsid_protein__Norovirus__CCX28643

SEQ ID NO: 19929 - RNA, 1623 nt, Artificial Sequence; identical to SEQ ID NO: 17662
  derived and/or modified sequence opt3 from major_capsid_protein__Norovirus__CCX28646

SEQ ID NO: 19930 - RNA, 1623 nt, Artificial Sequence; identical to SEQ ID NO: 17854
  derived and/or modified sequence opt3 from major_capsid_protein__Norovirus__CCX28649

SEQ ID NO: 19931 - RNA, 1623 nt, Artificial Sequence; identical to SEQ ID NO: 19921
  derived and/or modified sequence opt3 from major_capsid_protein__Norovirus__CCX28652

SEQ ID NO: 19932 - RNA, 1626 nt, Artificial Sequence; identical to SEQ ID NO: 18017
  derived and/or modified sequence opt3 from major_capsid_protein_VP1__Norovirus__AEE10000

SEQ ID NO: 19933 - RNA, 1626 nt, Artificial Sequence; identical to SEQ ID NO: 18020
  derived and/or modified sequence opt3 from major_capsid_protein_VP1__Norovirus__AEE10012

SEQ ID NO: 19934 - RNA, 1623 nt, Artificial Sequence; identical to SEQ ID NO: 18587
  derived and/or modified sequence opt3 from major_capsid_protein_VP1__Norovirus__AGJ52172

SEQ ID NO: 19935 - RNA, 1623 nt, Artificial Sequence; identical to SEQ ID NO: 18511
  derived and/or modified sequence opt3 from major_capsid_protein_VP1__Norovirus__AGJ52173

SEQ ID NO: 19936 - RNA, 1623 nt, Artificial Sequence; identical to SEQ ID NO: 18321
  derived and/or modified sequence opt3 from major_capsid_protein_VP1__Norovirus__AGJ52174

SEQ ID NO: 19937 - RNA, 1632 nt, Artificial Sequence; identical to SEQ ID NO: 18641
  derived and/or modified sequence opt3 from major_capsid_protein_VP1__Norovirus__AGJ52176

SEQ ID NO: 19938 - RNA, 1608 nt, Artificial Sequence
  derived and/or modified sequence opt3 from major_capsid_region__Norovirus__ADO85555
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuuagccggauguauaauggcuacgcuggugggguggagguucaggugcuguuggccggaaacgcguucacggcaggcaaacucgucuuugccgcugugcccccucauuucccacuggaaaauaucuccccgggccagauuaccauguuuccccacguaaucauugauguucgcacacuggagccugugcucuuaccacugcccgacguccgaaacaauuucuuucauuauaaccagcaaaacgaaccuuggaugcgucuuguggccauguuguacacuccacugagaucuaaugggucgggagaugacguguucaccgucucaugcaggguucuaacacggcccagcccggauuuugacuucaacuaucucgugccucccaccguagagaguaagacuaaaccauuuacacugccuauccuuaccauaggugagcugacuaauucccgcuuccccgugccaaucgaugaauuguacacgucucccaacgagagccucgucgugcagccucagaauggcagaugugcacuggacggggaauuacagggaaccacacaacugcucccaacugcuauuugcuccuuuaggggccggaucaaccagaagguuucaggugagaaucacguguggaacaugcaggucaccaauauuaacgggacaccguucgaucccaccgaagacgugccugccccacuuggaacgcccgauuucaguggcaaacuguuuggcguauugagccagcgcgaccaugacaaugcgugucgaucucacgaugccguuaucgcaacuaacuccgcuaaguucacaccuaagcuaggggccauacaaauuggaaccugggaggagaaugacgugcacaucaaccagccaacuaaauuuacacccgucggucuguucgaaucagagggcuuuaaucaguggacccucccgaacuauagcggggcucugacgcuuaacaugggacuggccccuccaguggcacccaccuucccuggcgaacaaauuuuguuuuucagaagucauaucccccucaaggguggggucgccgauccagugaucgacugccuguuaccucaggaguggauucagcaccuguaccaggaaucugcucccucccaaacagauguugcgcuaauaaggaucacuaauccagacaccggccgggugcucuuugaggcaaaacugcaucguagcggauacauuacaguagccaacacuggcucgcgcccgaucgucgugccugcuaauggguauuucagauuugauucuuggguuaaccaguucuacucccuugcccccaugggaaccgguaauggcaggcggcgagugcaguga

SEQ ID NO: 19939 - RNA, 1626 nt, Artificial Sequence
  derived and/or modified sequence opt3 from majore_capsid_protein__Norovirus__AFO84035
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucgggcccucgaaccuauccaacugccacugcucgaugugcgccgagucuuauggcacgcgacccaggaccaggaggagucuaugcgucugguguguaugcuuuauacacccuugagaaccaauucgccuggagaugaaucauuuguggucagcgguaggcugcuaaguaaaccagccgcagacuucaacuuuguuuaccucacucccccgauagagcggacaaucuaucgcaugguggaucugccuguacuucagcccagacugugcacccaugcuagguggccagccccuguguacggcuugcucgucgaccccucccugccaucuaauccccaauggcagaacgggcgggugcacguugauggaacguuacugggcacuaccccugugagcgguuccugggucucauguuucgcugccgaagcagccuaugaguaccagagugaggugggggaaguagcuacauuuacucucauugagcaagacggaagcgcguacguuccaggcgaucgcgcagccccgcuuggcuaucccgacuacucugggcagcuggaaaucgaggugcagaccgaaacaaccaagacgggagacaaauugaaggucacuacauucgauaugauucuagguccuaccacuaauguggaccaggucccauaucaaggcaagguguacgcuucccugacaaccgccucaagccucgaucugguugacgggcgagcaagagccgugcccaggaguguauauucuuuucaggauguccuuccugaguacaacgacggacuguuggugccacucgcucccccgcugggcccuuauuuaccaggugagguucugcuacgguuccguacguacaugcgccagcucgauaccgccgacgcagcggcucagcccaucgauugcgcccugccucaagaguucauauccugguuugcaagcaauaacuucacagugcagucggacgcccuuuugauuagauacaggaauacucugaccgggcagcuccuguuugaagcuaaacuuuauucugaaggcuacaucgccgucuccuauucaggaaguggcccccugacauucccaacugauggguuuuucgaggugguaagcugggugccucgguuguuucagcucgcauccguuggaucucuggucaccggucgaacauuaaagcaauga

SEQ ID NO: 19940 - RNA, 1623 nt, Artificial Sequence
  derived and/or modified sequence opt3 from major_viral_capsid_protein__Norovirus__AFN09918
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaaccagccgggacggcucuacgcgcggccacaaggccaccguguccacagggucaguccauuuuacuccuaagcugggaagcgugcaguucaguaccgauacaucuaaugacuuugagacuggucagaacacccgauucacaccagucggcgugguucaagauggguccaccacucaccagaaugaaccccagcaguggguguugccgaacuacagcggaagagacucgcacaauguacaucucgcuccugccgucgcaccaacguuucccggcgagcaacuguuauucuuuaggucuacaaugccugguuguuccggguaccccaacaugaaucuggauugccuccuuccacaggaaugggugcagcacuucuaucaggagucagccccugcucaaagugacguugcgcuguugcgguuugugaaccccgauaccggccguguccuauucgaguguaaacugcauaagccaggauacgugacuguagcacacaccggccagcacgaccucgugaucccgccuaacggguauuuucgcuucgauagcuggguuaaucaguucuacacacuggcccccaugggaaacggugcuggcagaaggcgggcccuuuga

SEQ ID NO: 19941 - RNA, 1623 nt, Artificial Sequence; identical to SEQ ID NO: 18112
  derived and/or modified sequence opt3 from major_viral_capsid_protein__Norovirus__AFN09921

SEQ ID NO: 19942 - RNA, 1623 nt, Artificial Sequence
  derived and/or modified sequence opt3 from major_viral_capsid_protein__Norovirus__AFN09924
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacgggacuacaccaugaaucucgcuagucugaacuggaauaacuaugauccgacggaagagauucccgccccucuugggacuccagacuucguaggaaagauccagggcguucugacacagaccacuaagggcaaugggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuauauuacagucgcccacaccgggcagcacgaucuggugauaccaccgaacggauacuuucgcuucgacuccuggguaaaucaguucuauacucuugcaccuauggguaacggcaccgggagaaggcgggcccuguga

SEQ ID NO: 19943 - RNA, 1623 nt, Artificial Sequence; identical to SEQ ID NO: 18112
  derived and/or modified sequence opt3 from major_viral_capsid_protein__Norovirus__AFN09927

SEQ ID NO: 19944 - RNA, 1623 nt, Artificial Sequence
  derived and/or modified sequence opt3 from major_viral_capsid_protein__Norovirus__AFN09930
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaucaccaagggcgacggcucuacucgcgggcacaaggcuacaguguacaccggaggugcccccuuuacgccuaaauugggcuccguccaguucucaaccgacacagaaaacgauuuugagacucaucaaaauaccaaguucacaccagugggggucauucaggacggaagcacuacccaccgaaacgaaccccagcaaugggugcucccgaguuacucuggcagaaauguucacaacgugcaucuggccccugcaguagcuccaacauuucccggugagcaguuacuguucuuuagguccaccaugccuggguguagcggcuaucccaauauggaucucgacugccuucugccacaggaguggguccagcacuucuaccaagaagcggccccugcacagucggauguggcuuugcuacgguuuguuaaccccgacacuggacgugugcuguucgaguguaaacuccauaagucuggcuaugucacgguggcccacacagggcagcacgaucugguaauaccaccgaacggauacuuucgcuucgacuccugggugaaucaguucuauacccuugcaccuauggguaacggcacugggagaaggcgggcccuguga

SEQ ID NO: 19945 - RNA, 1623 nt, Artificial Sequence; identical to SEQ ID NO: 18112
  derived and/or modified sequence opt3 from major_viral_capsid_protein__Norovirus__AFN09933

SEQ ID NO: 19946 - RNA, 1623 nt, Artificial Sequence; identical to SEQ ID NO: 18112
  derived and/or modified sequence opt3 from major_viral_capsid_protein__Norovirus__AFN09936

SEQ ID NO: 19947 - RNA, 1623 nt, Artificial Sequence
  derived and/or modified sequence opt3 from major_viral_capsid_protein__Norovirus__AFN09939
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggaggugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuaugucacaguggcccacaccgggcagcacgaucugguaauuccaccgaacggauacuuucgcuucgacuccugggugaaucaguucuauacucuugcaccuauggguaacggcaccgggagaaggcgggcccuguga

SEQ ID NO: 19948 - RNA, 1623 nt, Artificial Sequence; identical to SEQ ID NO: 18112
  derived and/or modified sequence opt3 from major_viral_capsid_protein__Norovirus__AFN09942

SEQ ID NO: 19949 - RNA, 1623 nt, Artificial Sequence
  derived and/or modified sequence opt3 from major_viral_capsid_protein__Norovirus__AFN09945
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucacaauuacaccaugaaccucgcuagccugaauuggaacaauuaugacccgacggaagagauucccgccccucuugguacuccagauuucguagggaagauccagggaguucugacacagaccacuaagggcgacggcucuacacgggggcauaaggcuaccguguacacgggauccgcccccuuuaccccuaaauuggguucaguccaguucagcacagacacugaaaacgauuuugagacccaccaaaauacaaaguucacuccagugggcgucauccaggacgggaguaccacacaccgcaacgaaccccagcaaugggugcucccgucuuacuccggaggcaauguucauaacgugcaccuggccccugcaguagcuccaaccuuucccggugagcaguuacuguucuuucgaagcacuaugccuggguguucgggcuaucccaauauggaucucgacugccuucugccacaggaguggguccagcauuucuaccaagaagcggccccugcacagucugauguggcuuugcuaagauuuguuaaccccgacacgggaagggugcuguucgaguguaaacuccacaaguccggcuaugucacaguggcccacaccgggcagcaugaucugguaauuccaccgaacggauacuuucgguucgacucaugggugaaucaguucuauacucuugcaccuauggguaacggcaccgggcgucgcagagcccuguga

SEQ ID NO: 19950 - RNA, 1623 nt, Artificial Sequence
  derived and/or modified sequence opt3 from major_viral_capsid_protein__Norovirus__AFN09948
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucgggcccucccagguaacgauguucccucauaucauaguugacgugcgccaacuggagccaguccuuaucccccugccugaugugcgaaauaacuuuuaucacuacaaucagucuaacgacucgaccauuaaguugaucgcuaugcucuauacaccacugcgugccaacaaugcgggagaagauguguucacugucucaugcagaguucugaccaggcccagcccggacuuugauuucauuuuucucgugccucccacaguagagagucggaccaaaccauucacugugccuaucuuaacagucgaagagaugaccaacucccgcuuucccauaccacuggagaaacuuuucacgggucccucuggcgccuucgugguucagccucagaaugggagauguacuaccgacggaguguugcugggcacaacucaacuaagcccagucaacauuugcaccuuuaggggugaugugacacauaucgcagggucccggaauuacaccaugaaccucgcuucacugaauuggaacaauuaugacccgacggaagagauucccgccccucuuggaacuccagauuucguaggcaagauccagggcguucugacacagaccacuaagggggacggaaguacacgcggucacaaggcuaccguguacacgggcggggcccccuuuaccccuaaauugggaagcguccaguucucuacagacacugaaaacgauuuugagacccaucaaaauacaaaguucacuccagugggcgucauccaggacgguuccaccacacaccgaaacgaaccccagcaaugggugcucccgucauacagcgggagaaauguucacaacgugcaucuggccccugcaguagcuccaaccuuucccggcgagcaguuacuguucuuuaggaguacuaugccuggauguucuggcuaucccaauauggaucucgacugccuucugccacaggaguggguccagcacuucuaccaagaagcggccccugcacaguccgauguggcuuugcuacgguuuguuaaccccgacacggggcgugugcuguucgaguguaaacuccauaagagcggauaugucacaguggcccacaccggucagcacgaucugguaauuccaccgaacggcuacuuucgcuucgacucgugggugaaucaguucuauacucuugcaccuauggggaacggaaccggcagaaggcgggcccuguga

SEQ ID NO: 19951 - RNA, 1623 nt, Artificial Sequence; identical to SEQ ID NO: 18112
  derived and/or modified sequence opt3 from major_viral_capsid_protein__Norovirus__AFN09951

SEQ ID NO: 19952 - RNA, 1623 nt, Artificial Sequence
  derived and/or modified sequence opt3 from major_viral_capsid_protein__Norovirus__AFN09954
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugaucucauuuucuuagugccucccacaguagagucccggaccaaaccauuuacugugccuauccugacagucgaagagaugaccaacucucgcuuccccauaccacuugagaaguuguuuacgggacccagcggugccuucgugguucagccucagaauggcagauguacuaccgacggggugcugcuaggaacaacucaacucuccccagucaacauuugcaccuucaggggcgaugugacacauaucgcagguucacggaauuacaccaugaaccuggcuagucuuaauuggaacaauuaugacccgacggaagagauucccgccccucuggggacuccagauuuuguaggaaaaauccagggcguuuugacacagaccacuaagggcgacgggagcacacgcggacacaaggcuaccguguacacggguggcgcccccuucaccccuaaacucgggucuguccaguuuuccacagacacugaaaacgauuucgagacccaucaaaauacaaaguuuacuccagugggagucauccaggacggcucaaccacacaccgaaacgaaccccagcaaugggugcugccgagcuacagugguagaaauguucacaacgugcauuuagccccugcaguagcuccaaccuuccccggggagcagcugcucuuuuucaggucuacuaugccuggcuguuccggauaucccaauauggaucuugacugccuguugccacaggaguggguccagcacuuuuaccaagaagcggccccugcacagagcgauguggcucuacugcgguucguuaaccccgacacgggccgugugcucuuugaguguaaacugcauaagucgggguaugucacaguggcccacaccggacagcacgaucuuguaauuccaccgaacgguuacuuccgcuuugacucuugggugaaucaguucuauacucuggcaccuaugggcaacgggaccggaagaaggcgggccuuguga

SEQ ID NO: 19953 - RNA, 1623 nt, Artificial Sequence
  derived and/or modified sequence opt3 from major_viral_capsid_protein__Norovirus__AFN09957
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguggcgcccccuuuaccccuaaauuggggucuguccaguucuccacagacacugaaaacgauuuugagacccaucaaaauacaaaguucacuccagugggagucauccaggacggcucaaccacacaccgaaacgaaccccagcaaugggugcucccgagcuacagugguagaaauguucacaacgugcaucuggccccugcaguagcuccaaccuuucccggggagcaguuacuguucuuuaggucuacuaugccuggcuguuccggauaucccaauauggaucucgacugccuucugccacaggaguggguccagcacuucuaccaagaagcggccccugcacagagcgauguggcuuugcuacgguuuguuaaccccgacacgggccgugugcuguucgaguguaaacuccauaagucgggguaugucacaguggcccacaccggacagcacgaucugguaauuccaccgaacgguuacuuucgcuucgacucuugggugaaucaguucuauacucuugcaccuaugggcaacgggaccggaagaaggcgggcccuguga

SEQ ID NO: 19954 - RNA, 1623 nt, Artificial Sequence
  derived and/or modified sequence opt3 from major_viral_capsid_protein__Norovirus__AFN09960
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucagaggaaggagcuccgccuuggugguucauccccagaauggucgguguacgacugacggcgugcugcuagggaccacacagcucucaccugucaacauuugcacuuuccgcggagaugugacccacaucgcaggcagucauaauuacacaaugaaccuggcuagccuuaauuggaacaauuaugacccaaccgaagagauuccggcuccccuggguacgccugauuuuguagggaagauccaaggaguuuugacucagacaaccaagggcgacggcucuacucgagggcacaaggccacaguguacaccggauccgccccauucacgcccaaacucgguucaguccaguuuagcaccgacacagaaaacgauuucgagacucaccagaauaccaaguuuacaccugugggcgucauccaagacgggaguacuacccauagaaacgaaccacagcagugggugcugcccucuuacuccggaggcaauguucacaacgugcauuuagcaccggccguagcuccuacauucccaggugagcaacugcucuuuuucaggagcaccaugcccggguguucgggcuauccuaauauggaucuugacugccuguugccccaggaguggguccagcacuuuuaccaggaagcggcaccagcccaaucugauguggcucuacugcgguucguuaacccugacacuggacgugugcucuuugaguauaaacugcacaaguccgauuacgucacgguggcccauacaggccagcacgaccuuguaauucccccaaacggguauuuccgcuuugauucaugggugaaucaguucuacacccuggcagccaugggaaacgguacuggcagaaggcgggcuuuguga

SEQ ID NO: 19955 - RNA, 1623 nt, Artificial Sequence
  derived and/or modified sequence opt3 from major_viral_capsid_protein__Norovirus__AFN09963
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccucauuuacccccaaauuggguagcguccaguucaguacagauacugagaacgacuuugaaacccaucaaaauacaaaguucacuccugugggcgucauccaggaugggucuaccacacaccgaaacgagccacagcaaugggugcuccccuccuacagcggaagaaauguucacaacgugcaucuggcaccggccguagcuccuaccuuuccaggcgaacaguuacuguucuuuaggucgacuaugcccgguuguucuggguauccuaauauggaccucgauugccuucugccccaggaguggguccagcacuucuaccaagaggcggcaccagcccaguccgacguggcuuugcuacgguuuguuaacccugauacgggccgugugcuguucgaauguaaacuccauaagucaggauaugucacaguggcccacaccggccagcacgaccugguaauucccccaaacggguacuuucgcuucgauaguugggugaaucaguucuauacucuugcaccgaugggaaacgguaccggcagaaggcgggcccuguga

SEQ ID NO: 19956 - RNA, 1623 nt, Artificial Sequence; identical to SEQ ID NO: 18112
  derived and/or modified sequence opt3 from major_viral_capsid_protein__Norovirus__AFN09966

SEQ ID NO: 19957 - RNA, 1623 nt, Artificial Sequence; identical to SEQ ID NO: 18926
  derived and/or modified sequence opt3 from major_viral_capsid_protein__Norovirus__AFN09969

SEQ ID NO: 19958 - RNA, 1623 nt, Artificial Sequence
  derived and/or modified sequence opt3 from major_viral_capsid_protein__Norovirus__AFN09972
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgacuuuacccccaaauuggguuccguccaguucucaacagauacugaaaaugacuuugagacccaucaaaacacaaaguucacuccugugggcgucauccaggaugggagcaccacacaccgaaaugaaccacagcaaugggugcuccccaguuacucuggaagaaacguucagaaugugcaccuggcuccggcgguagcaccuaccuuuccaggcgagcaguuacuguucuuuagguccacuaugcccgguuguagcggguauccuaacauggaccucgauugccuucugccccaggaguggguccaacauuucuaccaggaagccgcuccagcccagucggacguggcauugcuacgguuuguuaauccugauacgggccgugugcuguucgaguguaaacuccacaagucuggauaugucacaguggcccauaccggccagcacgaccugguaauucccccaaacggguacuuucgcuucgauuccugggugaaccaauucuauacucuugcuccgaugggaaaugguaccggcagaaggcgggcccuguga

SEQ ID NO: 19959 - RNA, 1593 nt, Artificial Sequence
  derived and/or modified sequence opt3 from major_viral_capsid_protein__Norovirus__AFN09975
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccgcgguuugaaucucgcaccaaaccuuucagcgugcccguacucacuguggaggaaaugacaaauuccagauuuccaauuccuuuagagaagcuguucaccggacccucaagugcguuugucgugcagccacagaacgguagguguacgacugauggcguucuuuuggggaccacacaacugagccccgugaauaucugcacuuuccggggagacgucacccauauaccuggcucucgcaacuacacaaugaaucuagccucccagaacuggaacucauaugguccaaccgaggaaauuccggcaccccucgggacgccugauuucgugggaaaaauccagggcguacugacucagacaacccgaacuaauggcagcacaagagggcacaaggcuaccguuuacacgggaagugccgacuuuucuccaaaacuugguagggugcaauucgcuaccgauacagacaaugacuuugagacuaaccagaauaccaaguucacacccgucggcgugauucaggauggguccacuaccccucggaacgaaccacaacaguggguccugcccagcuacucgggacguaauauccauaacgugcacuuggccccggcaguugccccuacauuuccaggcgagcagcuccuguucuuucgcucuaccaugcccgguuguuccggguauccuaauauggacuuagauugccugcucccccaggaaugggugcaauacuucuaucaggaggcugcgccagcacagucagacguagcccuucugagauuugucaacccugauacuggcaggguguuguucgaguguaagcuacacaaaaguggauacguuacgguggcucauacaggccagcacgaccuggucauucccccaaacggguauuuucgguucgauagcugggugaaucaauuuuacacccucgccccgaugggaaacgguacuggccgacgcagagcacuguga

SEQ ID NO: 19960 - RNA, 1623 nt, Artificial Sequence
  derived and/or modified sequence opt3 from major_viral_capsid_protein__Norovirus__AFN09978
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccuugcggugaauuuacaguuaguccaaggaaugcacccggcgagauccuuuggagcgccccucuggggccagauuugaaccccuacuuaucccaccuggcucggauguauaauggauacgccggcgguuucgaagugcaggucauucuagcggggaacgcauuuacugccggaaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggcgaugacguguucaccgucaguuguagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacggggcccucaagugcguucguugugcagccucagaacggaagaugcacuaccgauggugucuugcugggcacaacucaacuaagcccagugaauauauguaccuuuaggggagacguaacacauauuccggggucucggaacuacaccaugaaucucgccucccagaacuggaacucauaugaucccacggaggaaaucccugcaccacugggcacucccgacuucguugguaagauucagggggugcuuacacagaccacucgcacaaauggaagcacccgaggccacaaggcuacggucuacaccggcagugccgacuuuucuccuaagcuggggagagugcaauucgcuacagauacugacaaugauuuugagaccaaccagaauacaaaauucacuccagucggagugauccaggacgguuccaccacacccaggaacgaaccgcaacaguggguuuugccuagcuacucgggccggaauauccauaacgugcaccucgccccagcaguagcccccaccuuuccuggggagcagcuguuauucuuucguucuacuaugcccggaugcuccggcuauccaaauauggaucuggacugucuccuuccucaggaauggguccaauacuucuaucaggaggcugcgcccgcacagucagauguggcccuguugcgcuuuguuaacccagacacggguagagugcuauucgagugcaagcugcacaaaaguggguacgucacaguggcucauaccggccagcacgaucucguaauuccgccuaacggauauuuuagguucgacagcugggugaaucaauucuacacucuggcccccaugggcaacgggaccggacggcgacgcgcacuuuga

SEQ ID NO: 19961 - RNA, 1623 nt, Artificial Sequence
  derived and/or modified sequence opt3 from major_viral_capsid_protein__Norovirus__AFN09981
augaagauggccagcaacgacgugaaucccuccgauggcucugcugcaaaccuggucccugagguuaauaacgaagugauggcccucgagccaguagugggggcggcuaucgccgcaccggucgccggacagcaaaaugugauugaccccuggauaagaaacaauuucguucaggcuccugguggcgaauuuaccgugucaccaaggaacgcacccggggagauccuuuggagugccccucugggaccagauuugaaucccuacuuaagccaccuggcucggauguauaacggcuacgccgguggguucgaaguccaggugauucuagcgggaaaugcauuuacagccggcaaaaucauuuucgcugccguaccuccaaacuuuccgacugagggccucucccccucucagguuacgauguucccucauaucauaguggacguccgccaacuggagccagugcuuaucccccugccugaugugcgaaauaacuuuuaucacuacaaucagucgaacgacucaaccauuaaguugaucgcaaugcucuauacaccacugcgugcuaacaaugccggggaagaugucuucacuguuagcugcagagugcugaccaggcccaguccggacuuugauuucauuuuucucguaccucccacaguggagucccggaccaaaccauucacugucccuaucuuaacaguggaagagaugaccaacucucgcuuucccauaccacuggagaaacuuuucacgggacccagcuccgcguucguugugcagccucagaaugguagauguacuaccgacggcgucuugcuggggacaacucaacuaucaccagugaacauuugcaccuuuaggggagauguaacacauaucgccggcagucggaauuacaccaugaaccucgcaagccugaauuggaacaauuaugacccgacggaagagauucccgcuccucuugguacuccagauuucguugggaagauccagggagugcugacacagaccacuaagggcgacggcucuacacgcgggcacaaggccaccgucuacacgggauccgcucccuuuaccccuaaauuggguucagugcaguucagcacagacacugaaaacgauuuugagacccaucaaaauacaaaguucacuccagucggcgugauccaggacgggggaaccacacaccgaaacgaaccccagcaauggguucucccgaguuacucuggcagagaugugccuaauguacaccuggccccagcagucgcccccaccuuuccuggugagcaguuacuguucuuuagguccacuaugcccggguguagcggcuauccaaacauggaccucgauugccuucugccucaggagugggugcagcauuucuaccaagaagcugcgcccgcacagucggacguugccuugcuacgguuugugaauccagauacgggacguguccuguucgaguguaaacuccacaagucuggcuaugugacaguagcucauaccgggcagcacgaccuggugauuccgccuaacggauacuuucgcuucgauuccuggguuaaccaguucuauacucuugcccccauggguaauggcaccgggagaaggcgggcacuguga

SEQ ID NO: 19962 - RNA, 1623 nt, Artificial Sequence
  derived and/or modified sequence opt3 from major_viral_capsid_protein__Norovirus__AFN09984
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugauguucgaguguaagcuacacaaaaguggcuacgucacaguggcucauaccggacagcacgaucugguaauuccgccuaacggcuauuuuagguucgacagcugggugaaucaauucuacacucucgcccccauggggaacggaaccggucggcgacgcgcacuguga

SEQ ID NO: 19963 - RNA, 1623 nt, Artificial Sequence; identical to SEQ ID NO: 17702
  derived and/or modified sequence opt3 from major_viral_capsid_protein__Norovirus__AFN09987

SEQ ID NO: 19964 - RNA, 1623 nt, Artificial Sequence; identical to SEQ ID NO: 17702
  derived and/or modified sequence opt3 from major_viral_capsid_protein__Norovirus__AFN09990

SEQ ID NO: 19965 - RNA, 1623 nt, Artificial Sequence
  derived and/or modified sequence opt3 from major_viral_capsid_protein__Norovirus__AFN09993
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgauagauguacuaccgacggugucuugcugggcacaacucaacuaaguccggugaauauaugcaccuuuaggggagauguaacacauauucccgggagccggaacuacaccaugaaucucgccucucagaacuggaacuccuaugacccuacggaggaaaucccagcaccccugggcacuccugacuucguugguaagauucagggggugcuuacacagaccacucgcacaaauggaucaacccgaggccacaaggcuacggucuacaccggcagcgccgauuuuaguccaaagcuggggagagugcaauucgcuacagacacugauaaugacuuugagaccaaccagaauacaaaauucacucccgucggagugauccaggaugguucuaccacaccgaggaacgaaccucaacaguggguuuugccauccuacagcggccggaauauccauucggugcaccucgcccccgcaguagccccuaccuuucccggggagcagcuguuauucuuucguucuacuaugccaggauguuccggcuauccuaacauggaccuggauugccuccuuccccaggaauggguccaauacuucuaucaggaggcugcgccagcacagucagacguggcccuguugcgcuuuguuaauccggauacggguagagugcuauucgaguguaagcugcacaaaaguggguacgucacaguggcucauaccggccagcacgaccucguaauuccucccaacggauauuuuagguucgauagcugggugaaccaauucuacacucuggccccaaugggcaaugggaccggacggcgacgcgcacuuuga

SEQ ID NO: 19966 - RNA, 1623 nt, Artificial Sequence; identical to SEQ ID NO: 17702
  derived and/or modified sequence opt3 from major_viral_capsid_protein__Norovirus__AFN09996

SEQ ID NO: 19967 - RNA, 1623 nt, Artificial Sequence; identical to SEQ ID NO: 18926
  derived and/or modified sequence opt3 from major_viral_capsid_protein__Norovirus__AFN09999

SEQ ID NO: 19968 - RNA, 1623 nt, Artificial Sequence
  derived and/or modified sequence opt3 from major_viral_capsid_protein__Norovirus__AGC96529
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagagauauuccuaaugugcaccuggcaccagccguugcucccaccuuuccuggcgagcaguuacuguucuuuaggagcacuaugcccgguuguucgggguauccaaacauggaccucgauugccuucugccucaggagugggugcagcauuucuaccaagaagcggcacccgcccagucugacguagcuuugcuacgguuugucaauccagauacgggccgugugcuguucgaguguaaacuccacaaguccggauauguuacaguggcccauaccggccagcacgaccuggucauaccgccuaacggguacuuucgcuucgauucaugggugaaccaguucuauacucuugcacccaugggaaaugguaccggcagaaggcgggcccuguga

SEQ ID NO: 19969 - RNA, 1623 nt, Artificial Sequence
  derived and/or modified sequence opt3 from major_viral_capsid_protein__Norovirus__AGC96532
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaacuccugcaccacuggguacacccgacuucguugggaagauccagggagugcuuacccagacuacacgcaccaauggcagcacgcgaggccacaaggcuaccgucuacacagggagugccgacuuuucuccuaagcugggaagagugcaauucgcuacugauaccgacaaugauuuugagacaaaccagaauacuaaauucaccccagucggugugauucaggacggcuccacaacccccaggaacgaaccgcaacaguggguuuugccuagcuacucggggcggaauauccauaacgugcaccucgccccagcaguagcccccacuuuuccuggagagcagcuguuauucuuucguucuacgaugcccggcuguuccgguuauccaaauauggaucuggacugccuccuuccucaggaauggguccaauacuucuaucaggaggcugcgcccgcacagucagauguggcccuguugcgcuuuguuaacccagacacagggagagugcuauucgaguguaagcugcacaaaaguggcuacgucaccguggcucauacuggacagcacgaucucguaaucccgccuaacggcuauuuuagguucgacagcugggugaaucaauucuacacccuggcccccauggggaacggaacaggucggcgacgcgcacuuuga

SEQ ID NO: 19970 - RNA, 1644 nt, Artificial Sequence
  derived and/or modified sequence opt3 from major_viral_capsid_protein__Norovirus__AGC96535
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaagauacgccccguaugaggcugguggcaaugcuguacaccccucuccgggcuaauucgggcgaggacgucuuuacaguuucaugucgcguguuaacuagaccagcccccgauuucgaguuuaccuuccugguaccgccuacaguggaaagcaagaccaaacccuuuacucuuccaauuuugacacugggcgagcuaaguaacuccagguucccugcgcccaucgacaugcucuauaccgauccaaacgaaacgauugucgugcaaccccagaaugggcggugcacucuggacggaacccuucaggguacaacucagcugguuccuacccaaaucuguucuuuucgcggcacauugauaagccagaccucccgaucagccgauaguacggacagcgcaccaagagugaggaaccacccgcuccauguccagcugaagaauuuagaugggacucccuacgacccuacagacgaggugccagcuguacugggagccauugauuucaaaggcaccguuuucgguguggcuucucaacggaacacuacaggguccucagucggagccacccgugcacacgaagugcacaucgacacgaccaauccccgcuauacaccuaagcucggcagcguccuuaugcauagugagucuuccgauuuugacgauggccagccaacuagauucacccccauugggaugggagccgacgauuggcaccagugggagcugccggaauacagcggucauuugacacuaaacaugaaucuggcuccugcgguggcaccagccuuucccggcgagaggauccucuucuuucggucgguugugccuucugcugggggauacggcuccggucagaucgacugccugauuccccaagaauggguacagcacuucuaucaggaggccgcaccaucacagagugccgucgcucuuauacgauacgugaacccugauacugggcgcaauaucuuugaagccaagcugcacagagagggcuucauuaccguugcaaacagcggaaauaaccccaucguggucccaccgaauggcuauuuuagguucgaggcgugggugaaccaauuuuacacauugaccccuauggggacuggacagggucggcgcagaguacaguga

SEQ ID NO: 19971 - RNA, 1623 nt, Artificial Sequence
  derived and/or modified sequence opt3 from major_viral_capsid_protein__Norovirus__AGS16690
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaauuacaguggcucugauguuccuaacgugcaccuggcaccagccguagcucccaauuuuccuggugagcaguuacuguucuuuagauccaccaugcccggguguagcggcuauccaaacauggaccucgauugccuucugccucaggaguggguccagcauuucuaccaagaagcggcacccgcccagucggacguggcuuugcuaagguuuguuaacccagauacuggacgggugcuguucgaguguaaacuccacaagucuggcuaugucacgguggcccauacagggcagcacgaccugguaauuccgccuaauggauacuuucguuucgauuccugggugaaccaguucuauacccuugcacccauggguaauggcacugggcgcagaagggcccuguga

SEQ ID NO: 19972 - RNA, 1623 nt, Artificial Sequence; identical to SEQ ID NO: 19971
  derived and/or modified sequence opt3 from major_viral_capsid_protein__Norovirus__AGS16693

SEQ ID NO: 19973 - RNA, 1623 nt, Artificial Sequence; identical to SEQ ID NO: 18640
  derived and/or modified sequence opt3 from major_viral_capsid_protein__Norovirus__ALM98919

SEQ ID NO: 19974 - RNA, 1623 nt, Artificial Sequence; identical to SEQ ID NO: 18640
  derived and/or modified sequence opt3 from major_viral_capsid_protein__Norovirus__ALM98922

SEQ ID NO: 19975 - RNA, 1623 nt, Artificial Sequence; identical to SEQ ID NO: 18640
  derived and/or modified sequence opt3 from major_viral_capsid_protein__Norovirus__ALM98928

SEQ ID NO: 19976 - RNA, 1623 nt, Artificial Sequence; identical to SEQ ID NO: 18640
  derived and/or modified sequence opt3 from major_viral_capsid_protein__Norovirus__ALM98931

SEQ ID NO: 19977 - RNA, 1623 nt, Artificial Sequence; identical to SEQ ID NO: 17999
  derived and/or modified sequence opt3 from major_viral_capsid_protein__Norovirus__ALM98934

SEQ ID NO: 19978 - RNA, 1623 nt, Artificial Sequence
  derived and/or modified sequence opt3 from major_viral_capsid_protein__Norovirus__ALM98940
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccaggggauuguggauugucugaucccucaagaguggauucagcauuuuuaucaggaaucggcacccucucaguccgacguugccuuaaucagguacgugaauccagauacaggccggacucuguucgaggcuaagcuacaccgaucaggauauaucaccguagcgcacaguggcgacuacccgcucgucgugccugcaaacgggcauuuucgcuucgacagcuggguuaaucaauucuauucccuggcccccaugggaacagguaacggcagaaggcgggcucaguga

SEQ ID NO: 19979 - RNA, 1623 nt, Artificial Sequence; identical to SEQ ID NO: 18640
  derived and/or modified sequence opt3 from major_viral_capsid_protein__Norovirus__ALM98943

SEQ ID NO: 19980 - RNA, 1623 nt, Artificial Sequence
  derived and/or modified sequence opt3 from putative_capsid_protein__Norovirus__ABD73936
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauguuaucguggacguccgccaacuggagccagugcuuauaccccugccugaugugcgaaauaacuuuuaucacuacaaucagucgaacgacccaacaaucaaguugauugcaaugcucuauacuccccugcgugcuaacaaugccggggaagaugucuucaccguuucaugcagagugcugacaaggccgagcccugacuuugauuucaucuuucucguacccccaaccguggagagucggacuaaaccuuucacaguccccauuuuaaccguggaagagaugacgaacucccgcuuuccaaucccccuggagaaacuuuucacuggaccuucuggugcguucguugugcagccacagaauggcagauguaccacagacggggucuugcugggaacuacccaacuaagcccggugaacauaugcacauuuaggggcgauguaacccauauugccgguacgcacaauuacacuaugaaccucgcaucccagaauuggaacaauuaugaccccacagaagagaucccugcuccacuggggacccccgauuucguuggacggauucagggcaugcuuacucagacaacccgcggcgacgggucaacgcgaggacauaaggccaccgugaguacaggugacguccacuuuacuccuaagcugggcagcauccaauucaacaccgauacaaauaacgacuuugaaacugggcagaauaccaaguucacaccagugggagucgugcaggauggcaacgguacccaccaaaaugagccccagcaguggguuuugccgucuuacuccgggagaacuggccauaacgugcaccucgcuccugccguagcaccaacguuucccggagaacagcuguuauucuuuaggucaacaaugccuggcuguagcggguaccccaacaugaaucuggacugccuccuuccacaagaguggguccagcauuucuaucaggaggccgcuccugcgcagagugauguggcacuguugcgguuuguuaaccccgacaccggacgugugcuauucgaauguaaacugcacaagucugguuacgucacuguggcccacaccggccaacaugaucucguaaucccaccgaauggguauuuucgcuucgacuccugggugaaccaguucuacacacuggcuccuaugggaaauggcaccgguagaaggcgggcccuuuga

SEQ ID NO: 19981 - RNA, 1560 nt, Artificial Sequence
  derived and/or modified sequence opt3 from structural_capsid_protein__Norovirus__ABY67257
augaagaugaccgacaaagauacacaggaggccgcucccgcacugggccaagugcucccuccagaagucgagguugccaucccgguggaacccacugcgggggcucagauugccgcaccuacggccggacagguaaacccaauagaccccuggaucuucgcuaauuuugugcaggcaccucaaggugaguucaccauuagcccaaacaauaaccccggcgaaguccuuuuugagcuggaguuggggccugaauuaaauccauaccuggcccaccuaagacagauguauaacggauggacaggcuccaucagggugaagguuauucucgcugguaaugccuucucugcggggaaaaucauaguguuuugcaucccgcccggauucgaugcaucauaccugacuccuuuucaggccacccaguucccacaugucauuauggacgugcgggcugccgagcccaucgaaauuccucuugcagauguacgcaacguucuguuucaccaaggcccagacagucgaaugcguuugaugggcaugcucuauacaccccugagagcuaauagcggggccgauccguucguggucaccggaagggugcugacuuguccuucccccgacuuuucuuucuuuuuccucgugccaccuacagucgaggagcggucgacccccuucucaguuccaaacgugcccguauacagcuuaacgaauagucgcgcgccugugccaaucuaugaacugagauccucuaggagccuuccguugacuguccaguuucagaacggucggugcaccguggagggcgaucugcuagggacaacucccuucuccgccggagaccucuguucauuuaugugcauacgcggcgauacccagcauauugcagaacugcuugagccugacgaaagugcuuucguugugggugagcgaccagccacacugggguuucccgauuucagccaaugugucuugcaccuccuguuagcugacggaaccggcaucuggcaucagucucuggacgugaagaauccucagcacuuuacgccagccauuggccaaguaguucucuccggggaugugccccuuacuagaacaaggguccggcuggacuacguguugucaaccagccgugauaguuucuggguccuaccggacuaucgcucugaugugcugggauccgaguuugccccugcaguuagcgcuccaggugugggcgaaacucuccuguucuuuauggggagagcgcccguacagggaccuucgaacccccuuccaugccuguugccucucgagugggucuuccacuuugcaucugaaaggcccacaaaacaguccgacguggcccuguuaaauuacguuaacccagauaccggccgggugcuguucgaggcuaagcuauacucaagugguuuccucacggucaaccuggggaccgccaaugaagugguacuuccgacaagcggcaucuuuaaguucgcauccugggugucuuuguauuaccagcugcgaccuguuggaacucucagcgccggccgcagacugcccagggucgacggguauuga

SEQ ID NO: 19982 - RNA, 1653 nt, Artificial Sequence
  derived and/or modified sequence opt3 from viral_capsid_protein__Norovirus__AHA91656
augaugauggccagcaaggacgcuaccuccaacauggauggcacaucuggggcaggacagcuggugcccgagaauaacaauacuucagaaccuaucaacauggagccagucgccggugcgguuacggcugccgcaaccgccggccaagugaauaugauugacccguggauaaugaacaauuacguacaggcuccccagggggaguucacaaucaguccuaacaauacuccaggagauauucucuuugaccuucagcugggcccccacuugaacccuuucuuagcacaucugagccaaauguauaaugguuggguggggaacaugaaagucagagugguucuagccggaaaugcuuuuuccgccggcaagaucauugugugcuguaucccacccggcuucucugcgccuaacauaucgaucgcacaggccaccauguuuccacacgucauugcugaugugaggguacucgaaccgaucgacauuccccuggaugacguucggaaugugcuuuuccauaacaacgauaaugggaaccagacaaugcgccuguugugcaugcucuacaccccucugcgaucaggagguacuagcaguggcacagacccauuugucaucgccgggcgugugcugaccugucccacgccugauuucaauuuucucuucuuagugccacccacugucgaacagaaaaccaagcaauuuuccguuccgaaccugccucuuaaugugaugucuaacagcagaguacccuccuugcugaaugcaaugguggucucaccagaccaggcucaggugguucaguuccaaaacggaaggugcacacuagauggccagaugcucgguacuaccacagugagugccagcugugucgcgcgguuucgcgggaaaaccuuccaggccccugacaauagacugggaauaaaccuugcagagauuucuggcgagcccuaucacgcuuucgaauccccagcuccccugggcuuuccugacuucggggauggagacuggcaugugacggccacuaagguaacaccaucacaauuggaggccaaugauccgguugugauggguaacguccagcccuacaauccucaguuugcaccacaccucggcacccugguggucgaaaaccccacuccugacaaugugacaaccgggacggauuuacuguucaacaucaccuggcucagcaacagggccaauaaccgguuuaauccauggguuauucccaacuauggaaguacacuuacugaggcugcgcagcuggcaccgucuaucuucccuccaggcuuuggugagaccaucguguacuucaauuccacauuucccgccguaggggcuacuacccacgccgcaauuccuugcuugcuaccccaagaguucgucgcccauuuugugaacgaacaggcuccaauacgcggcgaagccgcacugcuccacuauaucgacccugauacacaucgaaaucugggagaguucaagauuuaccccgaaggcuuuguuaccugugugccaaacgucgggggaacugguccgcagagccuuccuacgaauggcaucuucguguucguaucgugggugucuagauacuaucagcugaaacccguugggacagcgggacaagcuaggcgguugggcuuucgucgcgucuga

SEQ ID NO: 19983 - RNA, 1629 nt, Artificial Sequence; identical to SEQ ID NO: 18047
  derived and/or modified sequence opt3 from VP1_capsid_protein__Norovirus__BAL60747

SEQ ID NO: 19984 - RNA, 1629 nt, Artificial Sequence; identical to SEQ ID NO: 18048
  derived and/or modified sequence opt3 from VP1_capsid_protein__Norovirus__BAL60751

SEQ ID NO: 19985 - RNA, 1629 nt, Artificial Sequence; identical to SEQ ID NO: 18055
  derived and/or modified sequence opt3 from VP1_capsid_protein__Norovirus__BAL60763

SEQ ID NO: 19986 - RNA, 1629 nt, Artificial Sequence; identical to SEQ ID NO: 18058
  derived and/or modified sequence opt3 from VP1_capsid_protein__Norovirus__BAL60765

SEQ ID NO: 19987 - RNA, 1629 nt, Artificial Sequence; identical to SEQ ID NO: 18069
  derived and/or modified sequence opt3 from VP1_capsid_protein__Norovirus__BAL60787

SEQ ID NO: 19988 - RNA, 1629 nt, Artificial Sequence; identical to SEQ ID NO: 18070
  derived and/or modified sequence opt3 from VP1_capsid_protein__Norovirus__BAL60789

SEQ ID NO: 19989 - RNA, 1629 nt, Artificial Sequence; identical to SEQ ID NO: 18081
  derived and/or modified sequence opt3 from VP1_capsid_protein__Norovirus__BAL60807

SEQ ID NO: 19990 - RNA, 390 nt, Artificial Sequence
  derived and/or modified sequence opt3 from capsid__Norovirus__ACL14997
auggccagcaacgacgcugcacccuccaaugauggcgccgcggggcuggugccugagucuaacaaugaagucauggcucucgagccaguugccggagcaucacuugccgcuccggugaccggucagacaaacaucauugaccccuggauaagaaugaauuucguacaagcaccuaacggcgaauuuacugugaguccaaggaauagccccggggagguccuguugaacuuagaacugggaccugagcuaaauccauaccucgcccaccugucccggauguauaacggcuacgcuggugggauggaggugcagaucaugcuugccggaaaugcguucacggcaggcaagcugauuuuugccgcuguucccccuuauaaccgccgaugcuga

SEQ ID NO: 19991 - RNA, 561 nt, Artificial Sequence
  derived and/or modified sequence opt3 from truncated_capsid_protein__Norovirus__ACB56490
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugaugcaacuggagccaguccuuaucccccugccugaugugcgcaauaacuuuuaucacuacaaucagucgaacgacucaaccauuaaguucgauagcaacgcuguguauacaacuuga

SEQ ID NO: 19992 - RNA, 627 nt, Artificial Sequence
  derived and/or modified sequence opt3 from truncated_capsid_protein__Norovirus__ACF77106
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccauuaguuga

SEQ ID NO: 19993 - RNA, 627 nt, Artificial Sequence
  derived and/or modified sequence opt3 from truncated_capsid_protein__Norovirus__ACF77107
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccguga

SEQ ID NO: 19994 - RNA, 66 nt, Artificial Sequence
  derived and/or modified sequence opt3 from truncated_capsid_protein__Norovirus__ACU28807
augaagauggccagcaacgacgcucaccccuccgauggcucugcagccaccucaagucagagauga

SEQ ID NO: 19995 - RNA, 312 nt, Artificial Sequence
  derived and/or modified sequence opt3 from truncated_capsid_protein__Norovirus__ACU28808
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcgggugggcuauga

SEQ ID NO: 19996 - RNA, 123 nt, Artificial Sequence
  derived and/or modified sequence opt3 from truncated_capsid_protein__Norovirus__ACV03476
augaagauggccagcaugacccccacacaccugaugggcccucagccaacuuccucucaaagaucaacgaugaggcucuggcuuuggaguccgcugagcgugcccuuguuacggcgccuguga

SEQ ID NO: 19997 - RNA, 87 nt, Artificial Sequence
  derived and/or modified sequence opt3 from truncated_capsid_protein__Norovirus__ACV03479
augaagauggccagcaugacaccccugcaccucaugauggugccuccagcuuccucucagagaucaaccaugaggcaauggcgguga

SEQ ID NO: 19998 - RNA, 1623 nt, Artificial Sequence
  derived and/or modified sequence opt3 from capsid_protein__Norovirus__AFN70960.1
augaagauggccagcaaagacgcuaaccccuccgauggcucuaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacugccggcaaggugaucuucgcugccguaccuccaaauuuuccgacggagggccucucccccucucagguuaccauguucccucauauuguggucgacgugcgccaacuggagccagugcuuaucccccugccugauguccgaaacaauuuuuaucacuacaaccagucgaaugacccaacaauaaaauugaucgcaaugcucuauacuccccugcgugcuaacaacgccggggaagauguuuucaccgugucaugcagaguacugacaaggccgagcccugacuuugauuucauuuuucucgugcccccaaccgucgagagucggacuaagccuuucacagugcccaucuuaaccguugaagagaugacuaauucccgcuuuccaauuccccuggagaaacuuuucacgggaccuucuggugcguucgugguccagccacagaacggcagauguaccacagacgggguguugcugggaacuacccaacuaagcccgguaaauaucugcacauuuaggggcgauguuacccauauagccgguacgcacaacuacacuaugaaucucgcaucccagaacuggaauaacuaugaccccacagaagagauuccugcuccacuggggacccccgauuucgugggacggauccagggcaugcuuacucagacaacccgcggcgacgggucaacgcgaggacauaaggccaccgucaguacaggugacgugcacuuuacuccuaagcugggcagcauucaauucaauaccgauacaaacaaugacuuugaaacugggcagaacaccaaauucacaccagucggagugguucaggauggcaaugguacccaccaaaacgagccccagcaguggguguugccgucuuacuccgggagaacuggccauaauguacaccucgcuccugccgucgcaccaacguuucccggagaacagcuguuauucuuuaggucaacaaugccuggcuguagcggguaccccaacaugaaccuggacugccuccuuccacaagagugggugcagcauuucuaucaggaggccgcuccugcgcagagugauguugcacuguugcgguuugugaaucccgacaccggacguguccuauucgaauguaagcugcacaaaucugguuacgugacuguagcccacaccggccaacaugaucucgugaucccaccgaacggguauuuucgcuucgacuccuggguuaaucaguucuacacacuggcuccucuuggaaacggcaccgguagaaggcgggcccuguga

SEQ ID NO: 19999 - RNA, 1629 nt, Artificial Sequence
  derived and/or modified sequence opt3 from VP1__Norovirus_and/or_Norovirus-like__X81879
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagaagaucacaauguuuccccacguaauuaucgauguucgcacucucgagccugugcugcugccacuccccgacguccgaaacagcuucuuucauuauaaucagaaagaugacccuaagaugcguauuguggcgauguuauacaccccacugagauccaacggcucuggggaugacguguucacagucucgugcaggguucuuacccggcccucaccggauuuugacuucacuuauuuggugccucccacaguagaaagcaaaaccaagccauuuacgcugccuauccuaacucucggagagcugaguaauucccgcuuccccgugccaauagaucaaauguacaccucucccaacgaggucaucagcgugcagugucagaacgguagaugcacacuugacggcgaacugcaggggacuacccaauugcagguuuccggaauuugugccuuuaagggcgaggugacagcacaccuccaugauaaugaccaccugaacaaugucaccaucacgaacuuaaaugguucaccuuucgacccaagugaagauauuccggcuccccugggggugccugacuuccagggaaggguauuuggcguuaucagccagcgggauaaacaaaacgccgcuggccacucugagccagccaaucgcgggcaugacgcagugguccccacuuauacagcccaguacaccccuaagcucggacagauacaaauugguacuuggcagacagaugaccuuaccgugaaccagccagucaaauucacgcccgugggccugaaugauaccgaacacuuuaaccaguggguugugccgcgauacgcuggggcguugaaucuaaacacaaaucuggcaccuuccguagccccagucuuccccggagagagacuccuguuuuucaggucacaucuuccucugaagggcgguuaugggaaccccgcuaucgacugcuugcucccacaagagugggugcagcacuuuuaccaggaagccgcaccuagcaugagugagguugcccuggugcgguauauuaaucccgauacuggccgugcuuuauucgaagccaaacugcaccgcgcaggauuuaugaccgucucuuccaacacaagcgcgccagugguagugccggcuaacggcuacuucagauuugacucguggguuaaucaguucuauucucuagccccuauggggacuggaaacgguaggcggcgaguccaauga

SEQ ID NO: 20000 - RNA, 1728 nt, Artificial Sequence
  derived and/or modified sequence opt3 from VP1__Norovirus_and/or_Norovirus-like__FJ875027
augaagauggccagcaacgacgcugcacccccuuccucugauggcgccgcgaaucuggugccagagaucaacaaugaagucauggcucucgagccgguugccggggcacagcuugccgcucccguggcaggacaauucaacgccauugacccuuggauaagacagaauuuuguacaggcuccagaaggugaguucaccgugucacccaggaacgccccuggcgaaauccuguugaauuuagagcuggggccacaccuaaaccccuuucuccagcaucuggcgcaaauguacaaugcauaugccggaggcauggagguccaggugguucuugcugguaacgccuucacagcagggaaaauuaucuuugcugccauuccuccacacuucccgcccgaacggcugagugcggcccaggcaacucaguuuccucaugugaucgucgaugugcgccaauuggagccaauaguacucccccugccugacguucgacacaaucuguuccauuuuaaccagcagaaugaugaacguaugcaccucguggcuuucuuauacacgccacugagagccaacagcggaaauggcgacgaugucuuuaccguguccugcagggugcuuacacggcccucucaggacuucgaguuuauguucuuggucccgccuacuguugagaagaaaaccguggcuuucucgcugccccaacuagccguaggcgaaaugucaaacagccgcuggccagcaagaaucacagggaugguggucgauccuaggcucccccaggugcugcacauucagaacggacgguguacccuugacgguacucugaugggcacaacccaauugaauccaaacgauaucugccgcauucgaggguauuuuaguuccucuagacccgagcuccugugugaaggagaggaaagcgagguuaauacgacuccuaccgacuccggcgccacaggugaucagacuccagaggugaggaccgggacacgggcuacccagcguugguucgcggucacggaauuaaacggacagguguacgacccguuuggcgaccaacccgcaccucugggcguaccagauuucaaggcccgcauccucggggcucuuaugagacugcccggaacuaauccuacaucaaacaguagguuugaggacgccuggguugaaaccaauaaccagacuacauaugcaccagccaccgguguggucgcuauaacgaccaaugauaacagcucuggcaauuacgccaacgaccagacaugcgaguucgugcccuuggggauugaaaucacugauuccgcaccguauaaugaguuugaccuaccuucauacggaggcgcggcuagcagugguaaccggaaucuggccccaaccgucgcacccacauucccuggggaggccauucuccuguuuggcucuaacaugcccguguacaaccgauccagcggaacugauaauaaagacauccgcugucuucugccaaacgaauauguucagcauuuguacgauacccaagcuccuucgcucucugacguggcccugguaagauaugucaauagggauacaggccggguguuauucgaggcaaagcugcaccgcgacggguuuaugaccguuaacgcuuccucaacuacggugcuacccgucgacggauacuucagauuugauaguugggugaaucaguucuaugcccucagcccaguagguaacgcguccggcaggcguuga

SEQ ID NO: 20001 - RNA, 1725 nt, Artificial Sequence
  derived and/or modified sequence opt3 from VP1__Norovirus_and/or_Norovirus-like__JF939046
augaagauggccagcaacgacgcugcaucccccucuucagauggcgccgcgaaucuggugccugagaucaacaaugaagucauggcucucgagccaguugccggggcacagcuugccgcuccgguggcaggacaauucaacgccauugaccccuggauaagacagaauuuuguacaggcuccugaaggugaguucaccgugaguccaaggaacgcccccggcgaaauccuguugaauuuagagcuggggccucaccuaaacccauuucuccagcaucuggcgcaaauguacaaugcauaugccggaggcauggagguccaggugguucuugcugguaacgccuucacagcagggaaaauuaucuuugcugccgugcccccucacuucccaccggaacggcugagcgcggcccaggcaacucaguuuccccaugucauuguggauguacgccaauuggagccuaucauacucccacugcccgacguucgacacaaucuguuccauuuuaaccagcagaaugaugaacguaugcaccucguggcuuucuuauacacgccucugagagccaacuccggaucuggcgacgaugucuuuaccgugucgugcagggugcuuacacggccaucacaggacuucgaguuuauguucuugguucccccgacugucgagaagaaaaccguggcuuucagccugccucaacuagccaucggcgaaaugaguaauucccgcuggcccgcaagaauuacagggcucguaguggauccaaggcugccucagguccuucacauccagaacggacgguguacccuggacgguacuuugaugggcacaacccaacucaaccccaaugauauuugccgcauccgaggguauuuuucuagcuccagaccagagcuguuaugugaaaacgaggaaucagccacggaccccaugccuacugagaccgauacagacaaucagccaccggaggugagggcucaggcgcgggcaacucagcguugguucgccguuaccgaacugaacggacaaguguacgaccccuuuggcgaucagccugcuccacucgguguccccgacuucaaggcccgcauacuuggggcacugaugagauugccuggaacaaauccaaccaguaacagcagguuugaggaugccuggguggaaacgaauaaccagacuacauaugcucccgccgcaggcguaguugcgauuaccacuaaugacaacucuuccucaaauuacgcuaacgaucagacaugcgaguucgugccgcuaggcaucgaaauuaccgacagcgccccuuaucaugaguuugaucugccaaguuacgggggagcagccucuuccgguaaucggaaccucgcucccacggucgccccuaccuuccccggcgaggcaauccugcuuuuugggagcaauaugccaguguacaaccgaaacacaggaacuucgaauaaagacauccgcugucuguugccuaacgaauauguccaacaccucuacgauacccaggcucccucucuguccgacguggccuuaguuagauaugugaauagggauacaggccggguacuguucgaggcgaagcuacaucgcgacgguuuuaugacugucaacgccucaaguaccacagugcucccaguugacggguacuucagauuugauagcugggugaaucaguucuaugcucuguccccggucggcaacgcaucuggaaggcguuga

SEQ ID NO: 20002 - RNA, 1722 nt, Artificial Sequence
  derived and/or modified sequence opt3 from VP1__Norovirus_and/or_Norovirus-like__JF930689
augaagauggccagcaacgacgcuaccgcacccucccaggauggcgccgcgaaucuggugccugaaucucaacacgaaguccucgcucuugagccaguugccggggcagcccuggcugcaccgguggccggacaguucaacgcuaucgaccccuggauuaaacagaauuuuguacaggccccugcgggugaguucacagugucaccaagaaacgcacccggcgaaauauugauggauuuagaacuggggccugagcuaaauccauuucucgcccaucuggcucaaauguacaacgccuaugcaggaggcauggagguccagaucauucuugcugguaaugccuucacugcggggaagaucauugugugcgccguucccccuaacuuuccaccggacaggcugagugcaagccaggcuacgaauuucccccacgugaucauggauguccggaccuuggaaccugugauacucccacugcccgacguacgcgccggauuuuuccauuacaaccagcugcgagagccucguaugagacucauggcuuuacuguauacaccacuuagggccaauggcacuggcgaugacgcauuuaccguuuccugucggguguugacacgccccaugcaagauuucgaauuuauguuccuggucccgccuaccguggagucuagagugacucccuuuucggucccaacauacccuguuguggagaugaccaacucaagguggcccgcccggaucagcgggaugcacguaaaugcuaaccagacgcuagcggugcaguuccagaauggacgcugcacucucgacggucaacugaugggcaccacacagcuuugugcagccgaugucugccgaaugagagggagguauaccaguacucgggcugaccuggccggaguggaucauacagaccagggcccauccuuggguaccgggcccucugacgauagcguuuccgugccugaagcacgugcccaaacgcgcacuggagucucagcucaccuccagcuggaggaauuaaacggccagccauacgagguguauggcgaacagccggcaccccuggggacaccugacuucagauguaggcucaugggagagcuuguacggcugccaaguaccagccccgcagcgcaaucucgauuucgcgaugcuuucuuugacacuuacggugccuuguucgccccugccguuggcuccacaaccuuuacggugaacaauucaagcaccagugauuucgcuaacgggcagccauuugaguuccuacccauuggagucgaaaucggcaauucugcccaguacgacgaguuugcacugccguccuauaacggugcuauuggggaaaauagacaccucgccccuguggcggccccaggcuuccccggagagaacaucgucuuuuucagcucgaaucugccugugugggauucuacauccgcucagaacaauaggcggauaucaugccuucugcccaacgaauuuguucaacauuucuacgacuugcaggcaccaagucagagcgauguggcccuccugcgcuauguacacccugaguccggcagagucuuauucgaguguaaacuguacagggacggguuucuaacugugaauggagcuucucucgccgaguuccccguuaacgguuauuuucguuucgauagcugggugaaucaguuuuucacccugucaccagucggcacagggaguggacggcgauga

SEQ ID NO: 20003 - RNA, 1719 nt, Artificial Sequence
  derived and/or modified sequence opt3 from VP1__Norovirus_and/or_Norovirus-like__GQ443611
augaagauggccagcaacgacgcuaccgcacccucccaggauggcgccgcgaaucuggugccugaaucucaacacgaaguccucgcucuugagccaguugccggggcagcccuggcugcaccgguggccggacaguucaacgcuaucgaccccuggauuaaacagaauuuuguacaggccccugcgggugaguucacagugucaccaagaaacgcacccggcgaaauauugauggauuuagaacuggggccugagcuaaguccauuucucgcccaucuggcucaaauguacaaugccuaugcaggaggcauggagguccagaucauucuugcugguaacgccuucacugcggggaagaucauugugugcgccguucccccuaauuuuccaccggacaggcugagcgcaucccaggcuacgaacuucccccacgugaucauggauguccggaccuuggaaccugugauacucccacugcccgacguacgcgccggauuuuuccauuacaaucagcugcgagagccucguaugagacucauggcuuuacuguauacaccacuuagggccaacggcacuggcgaugacgcauuuaccguuucuugucggguguugacacgccccaugcaagauuucgaauuuauguuccuggucccgccuaccguggagucgagagugacucccuuuucagucccaacauacccuguuguggagaugaccaauaguagguggcccgcccggaucagcgggaugcacguaaacgcuaaucagacgcuagcggugcaguuccagaacggacgcugcacucucgacggucaacugaugggcaccacacagcuuugugcagccgaugucugccgaaugagagggagguauacuuccacccgggcugaccuggccggaguggaucauacagaccagggcccaucuuugggugcagggcccagcaaugacccuguuuccgugccagaagcccguucacaaacccgcacgagugucagcgcucaccuccagcuggaggaauuaaacggacagccguacgagguguauggcgaacagcccgccccucugggcacuccagauuucuguugcagacucaugggggagcuuguaaggcugcccucuacauccccugcagcgcaaucacgguuucgagacgcuuucuuugauaccuacggagccuuguucgcaccagccguugguagcacuacauuuaccgugaacaauaguucuacguccgacuucgcuaacggccagcccuuugaguuccuaccgauuggggucgaaaucggaaauagcgcccaguacgaugaguuugcacugccuucguauaacggcgcuauuggugaaaaucgccaccucgccccaguggcggcccccggguucccuggcgagaacaucgucuuuuucucuuccaaucugcccgugugggacucaaccagugcucagaacaauagaaggauaagcugucuucugccaaacgaauuuguucaacauuucuacgauuugcaggcaccuucccagucugacguggcccuccugcgguauguacaccccgagagcggacgcgucuuauucgagugcaaacuguacagagauggcuuucuaacagugaauggggcuucacucgccgaguucccaguuaacggauauuuuagguucgacaguugggugaaucaguuuuucacucuguccccggucgguaccggcagcgggcguuga

SEQ ID NO: 20004 - RNA, 1719 nt, Artificial Sequence
  derived and/or modified sequence opt3 from VP1__Norovirus_and/or_Norovirus-like__EU224456
augaagauggccagcaacgacgcugcacccuccucugauggcgccgggaaucuggugccugagucacaccaggaaguccucccacuugcgccgguugcuggagccgcaaucgccgcucccgugguaggucaacagaacauuauagacccuuggaucaaagagaauuucgugcaggcaccacagggcgaauuuaccgucagucccaagaacagcccuggggaggugcugguuaauuuggaauuauccccaaaacugaaccccuaccuagaucaucucucuaagauguauaaugccuacgcuggaggcauggagauugagaucauucuggccgguaacgcguucacagcagggaaagugcuuaucgccgcugucccuccaaauuuuccgguggaaaacauaucgguaucacaagccagccaguucccccacguuaucguggacgucagaacucuggagccuauuagguugccacuccccgaugugcggacgaacuuuuuccauuauaccacacgcgacgaaccuaagaugcgaaucguggcauggcuguacacuccacugcguaccaauggaaguggcgaugacuccuuuacagucucuggcaggauucucaccagacccagcgcugauuucgaguuuuccuucuuaguuccgccuacuguggagacaaagaccguaucauuuagugugcccgggcugacggucgaagagaugagcaauucucgguggccagcccagaucaacggacuugugguucgcgguaaugaagcacaggugguccacuuccaaaacggcagaugcacuaccgaggggauguugcugggaacaacuacccuaaacguaaauuccauauguggccucagggguacaucaauuagccaugccagugugcgggaagcgccugcucugucugaggagaugcccccacuugaagacgagguugcccacggggcugccgcaaccuaugccgugggacgcgcugcggauacgacucuguggauccgagucgaggaacccaacggccagccuuacgacauuuuuggcgaacagccagcaccguuggggacacccgauuucaccgccgugaucaucggaacugcuauuagaccuaggacagccuccggugcauaucuccacgacgccuacgucgacacccggccaggcgaugcugacuucacgcccagcaccgggaauacaaaaauagugcugcguggaggcgguucggggcauguuggcgagggacacuacuggcaguuuaagccuaucgccguggagggcgggccaaaccgccccguauaucaagaauacaauuuaccggaguaugcaggaccuacugcgucuaaccauaaucuggcuccacccgucgccccuaaaaugcccggugaacuccuucuguuguucgaguccgauaugccagugugggacaacggcucagggagugcaccuacccagaagauucacugccuacugcccaaugauuuuguuacacacuucuuugaccuccaggccccagcucuggccgaagcagcccuucugagauacgugcauccggauagcggaaggacuuuguucgaguguaaacucuaucgggagggcuacauggucgugguagcuccuuccggucgacuggacuuucccuuagauggguauuuccgcuuugacucuugggugaacgcguucuacguucugagcccagucggcaauggacaaggcagaagguga

SEQ ID NO: 20005 - RNA, 1719 nt, Artificial Sequence
  derived and/or modified sequence opt3 from VP1__Norovirus_and/or_Norovirus-like__EF450827
augaagauggccagcuccgacgcuacccccucuucagauggcgcagggaaccuggugccugagagucagcaagaaguccucccacuugccccgguugcgggagcugcccuggcagcccccgugguaggucagcagaauaucauugacccuuggauaaaagagaacuucgugcaggcuccacaaggcgaauuuacagucagccccaaaaauuccccuggggagguguugguuaacuuagaacugucuccaagacuaaaucccuaccuccaccaucugucgaagauguauaacgcauacgccggaggcauggagguggagaucauucuugcugguaaugccuucacugcggggaagguccugaucgcagccgugccuccaaacuuuccgauugaaaauguaucagcuagccaggccagucaguucccccacguuaucguggaugucaggacguuggagccuauacggcucccacugcccgacgugcgcaccaacuuuuuccauuauacaacucaggaagaaccucgaaugcguaucguggcauggcuguacaccccacucagaacaaauggauccggcgaugacucuuuuaccgucagcggcaggauuuuaacucggcccuccccggauuucgaguuuucauuccugguuccucccacaguggaaaccaaaacgguaaguuuuagcgugccagggcuugucgugcaagacaugucuaacucccgcuggccugcucagaucucaggauugguugugagagguaaugaggcccaggucgugcacuuccagaacgggaggugcacuaccgaaggcaugcugcuaggaacaacuacccucaauauuaacagcaucuguggccugcggggucuuaguguaucucaagcguccguucgcggggcccccgcacugacagaggaaaugccacccuuggaggaugagguggcugacggagccgcugccaccuauacgcucacucgagcagccgauacagcucugugguuaagagucgaggagccugacggcaggccauacgauauauuuggcgaccagccggcgccccuggggaccccugacuucacugcagugauugucggaacagccauccggccacguaccacgagcggugcuuaucuccaugaugccuacguggacaccacacccggcgaugcagacuucacuccuucgaccgggaacacaaagauuguucuucgcggaggcgguucugggcacgugggccagggacacuacuggcaauuuaagccaaucgccguagaaggcgggggauccagaccccaguaucaggaguacaaucugccggauuaugcugguccuacugccucaaaccaugacuuggcaccacccgucgcgccuaggaugcccggcgaacuacugcuccuguucgagagugauaugccagugugggacaauggggcuggagccgccccugcacagaaaauccacugccuucugcccaacgaguuuauuacccauuuguucgaucuccaagcuccagcccuggcagaagcugccuuacugcgguacguucacccggacagcggccgaacacuauuugaguguaagcucuaucgcgaagguuacaugguggucgcggccccuguggggagacugaauuucccccuugauggcuauuuuagguucgacuccuggguaucugcuuuuuacguguugagcccaguuggaucaggccaggggcggcgcuga

SEQ ID NO: 20006 - RNA, 1719 nt, Artificial Sequence
  derived and/or modified sequence opt3 from VP1__Norovirus_and/or_Norovirus-like__JF781268
augaagauggccagcuccgacgcuacccccucuucagauggcgcagggaaccuggugccugagagucagcaagaaguccucccacuugccccgguugcgggagcugcccuggcagcccccgugguaggucagcagaauaucauugacccuuggauaaaagagaacuucgugcaggcuccacaaggcgaauuuacagucagccccaaaaauuccccuggggagguguugguuaacuuagaacugucuccaagacuaaaucccuaccucgaucaccugucgaagauguauaacgcauacgccggaggcauggagguggagaucauucuugcugguaaugccuucacugcggggaagguccugaucgcagccgugccuccaaacuuuccgauugaaaauaucucagcuagccaggccagucaguucccccauguaauaguugacgugaggacguuggagccuauccggcucccacugcccgauguccgcaccaacuuuuuccacuauacaacucaggaggaaccucgaaugcguauuguggcauggcuguacaccccacucagaacaaauggauccggcgacgauucuuuuaccgugagcggcaggaucuuaacucggcccuccccggacuucgaguuuucauuccuggucccucccacaguugaaaccaaaacggugaguuuuagcguaccagggcuuguggucgaggauaugucuaacucccgcuggccugcucaaauuaauggauuggugguuagagguaacgaagcccaggugguccauuuccagaaugggaggugcacuaccgagggcacacugcuaggaacuaccacacucucaaucaacagcauauguggccugcggggucuuagugugucucaggcguccguacgcggggcccccgcacugaccgaagagaugccacccuuggaggacgaaguugcugauggagccgcugccacguauacucucgcacgagccgcugacacaacccugugguuaagaguggaggaaccugauggcaggccauacgacauuuuuggcgaccaaccggcgccccuggggacuccugauuucacagcagucaucgugggaaccgccauucggccacguacggcuagcggugccuaucuccacgacgcauacgucgauaccacacccggcgacgccgauuucacuccuucgaccgggaacacaaagaucgugcuucgcggaggcgguucugggcauguuggccagggacacuacuggcaguuuagaccaaucgcuguggagggcgggggauccaggccccaauaucaggaauacaaucugccggacuaugccgguccuacugcaucaaaccacgauuuggcgccacccguagcuccucggaugcccggcgagcuacugcuccuguucgagagugacaugccagucugggauaauggggccggagcagccccugcucagaagauucauugccuucugcccaacgaauuuauaacccacuuguucgaccuccaggccccagcacuggcugaggccgcguuacugcgauacgugcauccggauagcggccgcacacuauuugaauguaaacucuauagagaggguuacaugguuguggccgcuccugcagggaggcugaauuucccccuugacggcuauuuucgguucgacuccugggucucugccuuuuacaucuugagcccagugggaucaggccaagggcgcagauga

SEQ ID NO: 20007 - RNA, 1698 nt, Artificial Sequence
  derived and/or modified sequence opt3 from VP1__Norovirus_and/or_Norovirus-like__KT245136
augaagauggccagcaacggcgcugcagcccccucccaggacggggcggcuaaucuggugccugaaucucaacaggaaguccucgcccuugagccaguugcaggagccgcucuggcagccccgguggcuggucaguucaacgccaucgaucccuggauuaaacagaauuuuguacaagcgccugcaggcgaguucaccgugucaccaagaaacgcccccggggaagucuugauggacuuagaacugggaccugagaugaauccauuucuagcucaccucgcccagauguacaacgcauaugcuggcgguauggaggugcagauaauccuggccgggaaugcguucacagccggaaagauuaucguuugcgcagugcccccuaacuuuccaccggauaggcuuagugcuagccaggccacuaauuucccccaugucauuauggacgugcggacgcuggaaccuguaguuuugccacuccccgaugugcgcgcuggcuuuuuccacuacaaccaacugcgagagccucguaugagacugaugacccucuuauauacaccacugagggccaauggcacuggggacgaugcauuuaccgucuccugucgggugcuuacacgccccauguuggacuucgaauuuauguuccuggugccgccuaccgucgagucuagaguuacucccuuuucggugccaacauacccuguaguggagaugaccaacucaagguggcccgcccggaucagcggaaugcaugucaaugcuaaccagacgcuagcggugcaguuccagaauggucgcugcacucucgauggccaacugauggggaccacacagcuuugugcagccgacguuugccgaaugagaggaagguauacuagcacccgggcugauccagccggccuggguugggacuuggaugcaacaacccucguggacgggcccgaagcccguguccaggcucgcauauccgugucugcccaucugcaauuagaggaacugagcggacagccuuacgagguauauggcgaacagccagcaccgcucggcacgcccgacuuccaguguagacuuaugggggagcugguuagguugccuuccgcgaacccaguggcucaaucacgguuucgagaugccuucuuugacacuuacggagcacuauucgcccccgcugucgguagugugacagucaccgugaacaauaguucuuccucagauuuugccaacgaccagccuuucgaguuucugccaaucggcguugaaauugggaauagcgcacgcuacgaugaguucgcucuccccaguuauaacggagccaucggcgaaaauagacaccuggcgccgauugccgcuccugguuuuccaggggagaaccuuaucuucuuuucuuccaaucugcccgugugggacagcacuucggcacagucuaacaggcggauauccugcuugcucccuaaugaguucauucagcacuuuuacgaucugcaagcccccucacagagugacguagcuuuacugcgcuauguccacccagaaacagauagauuccuauucgaguguaaacucuacagggacgccuuucugaccgugaacggcgcaagcuaugcggaguucccuguuaauggauacucccguuuugauucuugggugaagcaguucuuuacgcuuagccccgucggcaccgggucaggacggcgauga

SEQ ID NO: 20008 - RNA, 1659 nt, Artificial Sequence
  derived and/or modified sequence opt3 from VP1__Norovirus_and/or_Norovirus-like__AJ844470
augaagauggccagcaaagacgcuucccccucuaccgauggcgcagccaaccuggugccugagucacagcaagaaguccucgcgcuucagccaguugcuggggcccagaucgcagccccgguggcuggacaguucaauguaauugaccccuggauauaccaaaacuuugugcaggcaccugagggugaguucacagucaguccaagaaauagcacuggcgaaauccugaugaacuuggaauuagggccccagcugaauccuuaucuagcccaccucgcuaggauguacaacgccuaugcgggaggcuuugaggugcagguucugcuugcagguaaugccuucacggcugggaagauuaucgugugcgccgucccacccaacuuuccucugcaaaauauuuccgcagcucaggccacccaguugccacaugugguaguugaugugcggcagcucgagccggucgugcugccccugccugacgugcgcgcgggauucuaccacuauaaccaagucgaagagucucgaaugcgucucguugccaucuuauacacaccacugagaacuaauucggcaggcgaugacgcuuuuaccgugucauguaggauacuuacacggcccgccccugauuucagcuuuuucuuuuugaucccacccaccauugaaaguaaaacuacaccguucacccugccucgccuacccaucuccgagaugacgaacucuagauuuccacucguaauuaagggcaugguggucgacccuaaucugccccuucaggcuaacuuccagaaugggaggaucacucuggauggagaguugcaagguaccacacucccaacuagcaccuccauaggccggauuucagggacauauaugaguagcacccccucucgcaucauucagcaugaagacuccggagauucaacgcagccucgaguguucaacccaguuuggauggaccugacugagaacaauuggacagaauuucagccguucaacgaucaacccgccccuuuaggcugcccagacuuuaaagcaaagauccuggguacccucaucagacagcccaauaacgggagcuacuacuucgacgccuaucuugauacuaggcagcacggaacauuugcuccuuacaccggccaugcggcagugcacagugaccagcaagccggccaccuggcucagggguauaagauucaguucucuccaacgggaauagaguccgaucagaauaccgacuugaaccaacuacccgauuacgguggcgccaugacagucagcaaagggcuggcaccggccgcugccccugacuuuccaggagaaaugauccucuauuucgugucggauaugcccguacggaauccuaacggcgagcgucgcgacacugagauucugugucuucugccccaggaaaugguuacccauuuuuacgagcagcaggcaccaucucaaggugauguggcguuggucagauauaucaaugcugaaacagggagggugauguucgagggcaagcuccaccggaacggauuuuucacugucuccgccaccgcacgaacacugauagugccugacggcuacuuucgcuucgauucauggguuaauagauucuacaccuuaagucccauggggacuggaaacgguaggcggcgcgccagauga

SEQ ID NO: 20009 - RNA, 1659 nt, Artificial Sequence
  derived and/or modified sequence opt3 from VP1__Norovirus_and/or_Norovirus-like__KJ196291
augaagauggccagcaaagacgcuucccccucuaccgauggcacagcaaaccuggugccugagucacagcaagaaguccucgcccuucagccaguugcgggggcucagaucgccgcaccgguggccggacaguucaauguaauugaccccuggauauaccaaaacuuugugcaggcuccugagggugaguucacugucaguccaagaaauagcacgggcgaaauccugaugaacuuggaauuagggccccagcugaauccuuaucuagcacaccucgccaggauguacaacgcuuaugccggaggcuuugaggugcagguucugcuugcggguaaugcauucaccgccgggaagauuaucgugugcgcugucccacccaacuuuccucugcaaaauauuuccgccgcacaggcuacacaguugccacaugugguaguugaugugcggcagcucgagccggucgugcugccccugccugacgugcgcgccggauucuaccacuauaaccaagucgaagagucucgaaugcgucucguugcgaucuuauacacuccacugagaaccaauucggccggcgaugacgcauuuacagugucauguaggauacuuacccggcccgcuccugauuucagcuuuuucuuuuugaucccacccacuauugaaaguaaaacaaccccguucacgcugccucgccuacccaucuccgagaugacuaacucuagauuuccacucguaauuaagggcaugguggucgacccuaaucugccccuucaggccaacuuccagaaugggaggaucacccuggauggagaguugcaagguacaacucucccaaccagcacauccauaggccggauuucagggacccauaugaguagcacgcccucucgcaucauucagcacgaagacuccggagauucaacucagccucgaguguucaacccaguuuggauggaccugacagagaacaauuggaccgaauuucagccguucaacgaucaacccgcuccuuuaggcugcccagacuuuaaagccaagauccuggguacucucaucagacagcccaauaacgggagcuauuacuucgacgcauaccuugauacaaggcagcauggaaccuuugccccuuauacgggccacgcugcggugcacagugaccagcaagcaggccaucuggcccagggguacaagauucaguucucuccaaccggaauagaguccgaucagaauacagacuugaaccaacuacccgauuaugguggcgcuaugacugucagcaaagggcuggccccggcagccgcuccugacuuuccaggagaaaugauccucuacuucgugucggauaugcccguacggaauccuaacggcgagcgucgcgacaccgagauucugugucuucugccccaggaaaugguuacacacuuuuaugagcagcaggccccaucucaaggugauguggcauuggucagauacaucaaugcggaaacugggagggugauguucgagggcaagcuccaucggaacggauuuuucaccgucuccgcuacagcccgaacccugauagugccugacggcuauuuucgcuucgauucauggguuaauagauucuacacuuuaagucccauggggacgggaaacgguaggcggcgcgcaagauga

SEQ ID NO: 20010 - RNA, 1653 nt, Artificial Sequence
  derived and/or modified sequence opt3 from VP1__Norovirus_and/or_Norovirus-like__KU870455
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagauaacauuucugcugcccagaucacuaugugcccgcacguuauaguggacguccgccagcuugaacccgugcuguugccucucccagauauccgaaauagauuuuuccauuauaaccaggaggacacgccccguaugaggcugguggcaaugcuguacaccccucuccgggcuaauucgggcgaagaugucuuuacaguuucaugucgcguguuaacuagaccagcccccgacuucgaguuuaccuuccugguaccgccuacaguggagagcaagaccaaacccuuuacucuuccaauuuugacacugggcgaacuaaguaacuccagguucccugcggccaucgauaugcucuauaccgaccccaacgagucuauugucgugcaaccacagaaugggcggugcacgcuggauggaacucuucaggguaccacacagcugguucccacucaaaucugugcauuucgcggcaccuugauaagccagaacgcucgagccgcugaccucacagauuccccucagagagccagggaccacccacugcaugugcaagucaagaauuuagacgggacccaguacgauccgacggacgauauucccgcagugcugggagccaucgacuucaaaggcacuguauucgguguugcuucacagcgggaugugagugggacacaggaacaaggacacuaugcgacccgugcacacgaggcccauauugacacuacagauccuaaguacgcuccaaagcucggcaccauccuuaucaaaagcgaaucuacggacuuuaccacaaaccagcccauucgcuucacuccugucggcaugggggauaauaacuggagacagugggagcugccagacuacuccggaucauugacccuaaauaugaaccuggcccccgcagugagcccgaguuuuccuggugagaggauacucuucuuucggucuaucgucccauccgccggcggguauggaagcggcuacauugauugccugaucccccaggaaugggugcaacacuucuaucaggaggcugccccuucgcagucugcaguugcgcuugugcgauacguaaaucccgacacaggucgcaacauauuugaagcuaagcugcauagagagggguucuugacugucgccaauuccggcaacaauccaauugugguuccucccaacggauauuuuagguucgaagcaugggugaaucaguuuuacacccucgccccaaugggcucagggcaaggacggcgcagagcucaguga

SEQ ID NO: 20011 - RNA, 1653 nt, Artificial Sequence
  derived and/or modified sequence opt3 from VP1__Norovirus_and/or_Norovirus-like__AF414408
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggaugucaagcagcuugagcccgugcuguugccucucccagacauccgcaaucgauuuuuccauuauaaccaggaagauacgccccguaugagacugguggcaaugcuguacaccccucucagggcuaauucgggcgaggacgucuuuacaguuucaugucggguguuaacucgcccagcccccgauuucgaguuuaccuuccugguaccgccuacaguggaaagcaaaaccaagcccuuuacucuuccaauuuugacacugggcgagcuaaguaacuccagauucccugcggccaucgacaugcucuauaccgaucccaacgaaucuauugucgugcaaccacagaaugggaggugcacgcuggacggaacucuucaggguaccacacagcugguucccacucaaaucugugcauuucggggcaccuugauaagccagacagcucgcgccgcugauuccaccgggucaccucagcgagccagaaaccacccacuccaugugcaagucaaaaaucuggacggaacgcaguacgauccgacugacgacauucccgcaguguuaggcgccaucgauuucaaggguacaguauucgggguugcuagucagagggacgugagcggacagcaagagcagggccacuaugcgacccgggcacacgaagcccauauugauacuacagacccuaaguacgcuccaaaacugggcaccauccucaucaagucugauuccgacgauuuuaacacgaaucagcccauucguuucaccccugucgggaugggagacaacaauuggcgccagugggagcuuccagauuacucaggucaccugacauugaacaugaaucuagcccccgcagugagcccgaguuuuccuggcgagagaauacuguucuuuaggucuaucgucccauccgccgggggauauggcagcgguuacauugacugccucaucccccaagaaugggugcagcauuucuaucaggaggcugccccuucgcagucugcaguugcgcuggugcgguacguaaaccccgauacugggcgaaauauauuugaagcuaaacuucaccgcgagggcuuccugaccgucgccaacuccggaaauaacccaauugugguuccucccaauggcuauuuuagauucgaagcaugggugaaccaauuuuacacauuggccccaauggggucaggacaggguaggcggcgcgcucaguga

SEQ ID NO: 20012 - RNA, 1653 nt, Artificial Sequence
  derived and/or modified sequence opt3 from VP1__Norovirus_and/or_Norovirus-like__AB084071
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagauaacauuucugcugcccagaucacuaugugcccgcacguuauaguggacguccgccagcuugaacccgugcuguugccucucccagauauccgaaauagauuuuuccauuauaaccaggagaauacgccccguaugaggcugguggcaaugcuguacaccccucuccgggcuaacucgggcgaagacgucuuuacaguuucaugucgcguguuaacuagaccagcccccgauuucgaguuuaccuuccugguaccgccuacaguggagagcaagaccaaacccuuuacucuuccaauuuugacacugggcgaacuaaguaacuccagguucccugcggccaucgacaugcucuauaccgaucccaaugagucuauugucgugcaaccacagaacgggcggugcacgcuggacggaacucuucaggguaccacacagcugguucccacucaaaucugugcauuucgcggcaccuugauaagccagacagcucgagccgcugauuccaccgacucaccucagagagccagggaucacccacuccaugugcaagucaagaaucuggacgggacgcaguacgacccgacugaugacauucccgcaguguuaggagccaucgauuucaaaggcacaguauucgguguugcuagucagcgggacgugagcgggccucaggaacaaggacacuaugcgacccgugcacacgagacucauauugauacaaccgacccaaaguacgcccccaagcugggcacgauccucaucaaaucugaauccaacgauuuuauuaccaaucagccuauacgcuucacaccagucggcaugggggacaacaauuggagacagugggagcuucccgauuacucaggaaggcugacuuugaacaugaaucuagcuccggccgugagcccuaguuuuccaggugagcggauccuguucuuucgaucuauuguccccuccgcaggcggguauggaagcggcuacaucgacugccucauaccucaggaaugggugcaacacuucuaucaggaggccgcucccucgcagucugccguugcacuggugcgcuacguaaacccagauaccgguagaaauauuuuugaagcgaaacuucauagggagggguuccugacagucgcuaacuccggcaauaacccuaucgugguucccccaaauggauauuuucgguucgaagccugggugaaccaguuuuacacuuuggcaccgaugggcucagggcaaggacgcagaagggcccaguga

SEQ ID NO: 20013 - RNA, 1653 nt, Artificial Sequence
  derived and/or modified sequence opt3 from VP1__Norovirus_and/or_Norovirus-like__AF414407
augaagauggccagcaacgacgcugcacccuccaaugauggcgccgcgaaccuggugccugaggcuaauaacgaagucauggcccucgagccaguugugggggcaucuaucgccgcuccggcaguaggacagcaaaauauuauagaccccuggaucagagaaaacuucgugcaggccccucagggugaguuuaccgucucaccaaggaauagucccggcgaaaugcuucugaacuuggaguuagggccugagcugaauccauaccuaagccaccucucccggauguauaacggauacgcuggcgguaugcagguccaaguugugcuggccgggaaugcguucacagcaggaaagauuaucuuugccgcugugcccccucauuucccaguggaaaacauuucugccgcacagaucacuaugugcccgcacguaauaguugaugugcgccagcuugagcccguccuguugccucucccagacauccgaaauagauuuuuccauuauaaccaggaaaauacgccccguaugaggcugguggcuaugcuguacaccccucuccgggccaacucgggcgaggauguguuuacagucucaugucgcguuuuaacuagaccagcgcccgacuucgaguuuaccuuccuggugccgccuacaguagaaagcaagaccaaacccuuuacucuuccaacauugacccugggcgagcuaaguaacccuagguuccccgccgcaauugauaugcucuauacggacccaaaugaauccaucgugguccaaccccagaacgggcggugcacucuggauggaacccuucaggguacaacucagcuggugccuacccaaauuugugcuuuucgcggcacauugaucucucagaccgcccgagcugccgacagcacggauuccccacagagagcaaggaaucacccgcuccauguucaagugaagaaccuggacgggacucaguacgaucccacagacgacauaccugccgucuuaggagcuauugauuucaaaggcaccguguucgguguagcgucacagcgggacguuagugggcagcaagagcagggacacuaugcaacucgugcccacgaagcucauaucgauacaaccgacccaaaguacgcccccaagcugggcacgauucucaucaaaagcgauucugacgauuuuaauaccaaccagccuauccgcuucacaccagugggcaugggggacaauaacuggagacagugggagcuucccgauuacuccggaaggcugacuuugaauaugaaccuagcaccggccgucucaccuagcuuuccaggugagcggauucuguucuuucgaaguauagugcccucugcuggcggguauggauccggcuacaucgacugccucauuccucaagaauggguccagcacuucuaucaggaggccgcacccagccagucggcgguggcucugguucgcuacgugaauccagauaccgguagaaacaucuuugaagccaaacuucauagggagggguuccugacaguagcaaauucuggcaacaauccuauagucgugcccccaaacggauauuuucgguucgaagccuggguuaaccaauuuuacacuuuggcuccgaugggcuccgggcagggacgcagaagggcccaguga

SEQ ID NO: 20014 - RNA, 1653 nt, Artificial Sequence
  derived and/or modified sequence opt3 from VP1__Norovirus_and/or_Norovirus-like__AB039777
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccccauguauaacggauacgccggcgguaugcagguucaagugguccuggcugggaaugccuucacagcgggaaaaauuaucuuugcagccgugccuccacauuucccgguagauaacauuucugcugcccagaucacuaugugcccccacguuauaguggacguccggcagcuugaaccugugccacugcccuugccugauauccgcaaucgauuuuuccauuauaaccaggagaauacgccacguaugagacucguggcaaugcuguacacaccccugagggcuaacucgggcgaagacgucuuuaccguuucaugucgggugcucacucgcccggccccugauuucgaguuuaccuucuuaguacccccaacaguggagagcaagaccaaaccuuuuacucugcccauucuuacauugggcgaacugaguaacuccagauucccagcggccaucgacaugcuauauaccgaucccaaugagucuauugucgugcaaccucagaacgggaggugcacgcucgacggaacucugcaggguaccacacagcuuguuccaacucaaaucugugcauuucggggcacccugauaagccagacagcucgcgccgcugauuccaccgacucaccgcagcgagccagagaucaccccuugcaugugcaagucaagaaucucgggggaacgcaguacgacccuacugacgauauuccagcagugcugggcgccaucgacuucaaagguacaguauucgggguugcuagucagagggaugugagcggaccccaggaacaaggccacuaugcgacccgggcacacgaggcccauauugacacuacagauccuaaguacgcuccaaaguuaggcaccauccugaucaaaucugaauccaacgacuuuacgaccaaucagcccauucguuucacaccggucgggaugggagauaacaauuggcgccagugggagcucccugacuacucagguagacuuacucugaacaugaauuuggccccagcagugagccccaguuuuccuggcgagaggauacuauucuuucggucuaucguccccuccgccgggggauauggcagcgguuacauugauugccugaucccacaggaaugggugcaacacuucuaucaggaggcugccccuucgcagucugcaguugcgcucgugcgauacguaaaccccgacaccgggcgcaauauauuugaagcuaagcugcauagagagggcuuccuuacagucgccaacuccggaaauaacccaauugugguuccgccuaauggcuauuuuagguucgaagcaugggugaaccaguuuuacacucuggcccccauggggucaggacaaggucggcgcagagcucaguga

SEQ ID NO: 20015 - RNA, 1653 nt, Artificial Sequence
  derived and/or modified sequence opt3 from VP1__Norovirus_and/or_Norovirus-like__AB078337
augaagauggccagcaacgacgcugcacccuccaaugauggcgccgcgaaccuggugccugaggcuaaugacgaagucauggcccucgagccaguugugggggcaucuaucgccgcuccgguagugggacagcaaaacauuauagaucccuggaucagagaaaauuucguccaggcaccucagggugaguuuaccgugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacagcgggaaagauuaucuuugcagccgugcccccucauuucccaguagaaaauauuucugcugcccagaucacuaugugcccgcacguuauaguggacguccgccagcuugagcccgugcuguugccucucccagauauccgaaacagauuuuuccauuauaaucaggaaaacacgccccguaugaggcugguggcaaugcuguacaccccucuccgggcuaauucgggcgaggacgucuuuacaguuucaugucgcguguuaacuagaccagcccccgauuucgaguuuaccuuccugguaccgccuacaguggaaagcaagaccaaacccuuuacucuuccaauuuugacacugggcgagcuaaguaacuccagguucccugcggccaucgacaugcucuauaccgaucccaacgaaucuauugucgugcaaccacagaaugggcggugcacgcuggacggaacucuucaggguaccacacagcugguucccacucaaaucugugcauuucgcggcaccuugauaagccagacagcucgagccgcugauuccaccgacucaccucagagagccaggaaccacccacuccaugugcaagucaagaaucuggaugggacgcaguacgacccgacugacgauauucccgcaguguuaggagccaucgacuucaaaggcacaguauucgguguugcuagucagcgggaugugagcgggcagcaagagcagggacacuaugcgacccgugcacacgaagcccauauugacacuacagauccuaaguacgcuccaaagcugggcaccauccucaucaaaucuggcuccgacgauuuuaacacgaaucagcccauucgcuucaccccugucgggaugggagacaacaauuggagacagugggagcuuccagauuacucagguaggcugacauugaacaugaaucuagcccccgcagugagcccgaguuuuccuggcgagcggauacuguucuuucgaucuaucgucccauccgccgggggauauggcagcgguuacauugacugccucaucccccaagaaugggugcagcacuucuaucaggaggcugccccuucgcagucugcaguugcgcuggugcgcuacguaaaccccgauacugggagaaauauauuugaagcuaaacuucauagggagggcuuccugaccgucgccaacuguggaaauaacccaauugugguuccucccaauggcuauuuucgguucgaagcaugggggaaccaauuuuacacauuggccccaaugggauccggucagggccgcagaagggcucaguga

SEQ ID NO: 20016 - RNA, 1653 nt, Artificial Sequence
  derived and/or modified sequence opt3 from VP1__Norovirus_and/or_Norovirus-like__AB039776
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccccauguauaacggauacgccggcgguaugcagguucaagugguccuggcugggaaugccuucacagcgggaaaaauuaucuuugcagccgugccuccacauuucccgguagauaacauuucugcugcccagaucacuaugugcccccacguuauaguggacguccggcagcuugaaccugugccacugcccuugccugauauccgcaaucgauuuuuccauuauaaccaggagaauacgccacguaugagacucguggcaaugcuguacacaccccugagggcuaacucgggcgaagacgucuuuaccguuucaugucgggugcucacucgcccggccccugauuucgaguuuaccuucuuaguacccccaacaguggagagcaagaccaaaccuuuuacucugcccauucuuacauugggcgaacugaguaacuccagauucccagcggccaucgacaugcuauauaccgaucccaaugagucuauugucgugcaaccucagaacgggaggugcacgcucgacggaacucugcaggguaccacacagcuuguuccaacucaaaucugugcauuucggggcacccugauaagccagacagcucgcgccgcugauuccaccgacucaccgcagcgagccagagaucaccccuugcaugugcaagucaagaaucucgacgggacgcaguacgacccuacugaugacauuccagcagugcugggagccaucgauuucaaaggcacaguauucgguguugcuagucagagggacgugagcgggccccaggaacaaggacacuaugcgacccgggcacacgaggcccauauugauacuacagacccuaaguacgcuccaaaguuaggcaccauccugaucaaaucugaauccaacgauuuuacgaccaaucagcccauucguuucacaccggucggcaugggggacaacaauuggcgccagugggagcucccugauuacucaggaagacuugcccugaacaugaauuuggcaccagccgugagccccaguuuuccuggugagaggauacuauucuuucggucuaucguccccuccgcuggcggguauggaagcggcuacauugacuaucugaucccacaggaaugggugcaacacuucuaccaggaggccgcaccuucgcagucugcgguugcucucgugcgauauguaaaccccgauacuggucgcaauauauuugaagccaagcugcauagagagggguuccuuaccgucgcaaacuccggcaauaacccaauugugguuccgccuaauggauacuuuagguucgaagccugggugaaccaguuuuauacacuggcucccaugggcucagggcaaggacggcgcagagcccaguga

SEQ ID NO: 20017 - RNA, 1653 nt, Artificial Sequence
  derived and/or modified sequence opt3 from VP1__Norovirus_and/or_Norovirus-like__KT030674
augaagauggccagcuccgacgcugcacccucuaccgauggcgccgggaaccuggugccugagucacagcaagaaguccucccacuugcgccgguugcuggagccgcacuggccgcucccgugguaggucagacaaauaucauugacccuuggauaaaagagaacuucgugcaggcaccacagggcgaauuuacugucagucccaagaauagcccuggggagaucuuggugaacuuagaacugggaccaaaacuaaaucccuaccucgaucaccuguccagaauguauaacucuuacgccggcgguauugacguuauggugguccuugcugggaaugccuucacggcgggaaaggugcugaucgcagccauuccuccaaacuuuccgguagagggcguuucggcuucacaagccacccaguucccccaugugaucauagaugucaggacauuggacccugugcggcucccacugcccgaugugcgcagcaccuuuuuccacuauacuaaugacacagagccuaaaaugcgacuggucaucuggcucuacaccccauuacguacuaacggcaguggggaugacuccuuuacaguuucuggaaggauucugaccagacccagccaggauuucgaauuugcauuccuuaucccgccuacgguggagacuaagaccacacccuuuuccguaccagguuucucagugcaggaaaugaguaauagccgguggccugcugccauuucugcgauggucgugcgcggcaacgagccccaaguugugcaguuucagaaugggagagcccauuuggacggaaugcugcuaggcacuaccccagucucccccaacuauaucgcaucauacagggguauaagcacagggaauagucggucugcuuccagcgaggccgaugaacgcgcugugggaucguucgacguauggguucgacuccaggagccugacggccaaccauaugauauuuucggcaagcagccggcccccaucgggaccccugacuuuaaagcagugauugucggauucgccgcuagaccacugacgucugguuccuacgcgaacgaagcauacgugaacacuacagccucagauuaugcucccgccaccggcaauaugagguuuacuguccggaacgggggaacaggccacaucagugcaaauaaguacugggaguucaaauccuuugguguggaaggggagcgucauaccgacauccaguaucaagaguacgaacuuccugauuauagcggccagguugccucuaaccacaaucuggcuccacccguggccccgcgcaugccuggagagagcuugcuccuguuccagucaaacaugccaguaugggacgauggcagaggggaaaguacgcccaagaaaauucacugcuuacugccucaggaguuuauaggacauuucuuugacaagcaagcacccucccucggugaugcggcccuucugagguacgucaaucaggaaaccaaccggguguuguucgaguguaagcuauaucgagacggcuacaucacaguugcugcaagcucugggcugcucgauuuuccacuggacggauucuuucgcuucgacucaugggugaguagcuucuacauucuuuccccugucggcucuggucaggggagaagguga

SEQ ID NO: 20018 - RNA, 1653 nt, Artificial Sequence
  derived and/or modified sequence opt3 from VP1__Norovirus_and/or_Norovirus-like__DQ093067
augaagauggccagcaacgacgcugcacccuccaccgauggcgccgggaaucuggugccugagucucagcaagaaguccucccacuugcgccgguugcuggagccgcacuggccgcucccgugguaggucagacaaacaucauugacccuuggauaaaagagaauuucgugcaggcaccacagggcgaauuuacugucucacccaagaacaguccuggggagaucuuggugaauuuagaacugggaccaaaacuaaaccccuaccucgaucaccugagcagaauguauaauuccuacgccggcgguauugacguuauggugguccuugcugggaacgccuucacggcgggaaaggugcugaucgcagccauuccuccaaauuuuccgguagagggcguuucugcuucgcaagccacccaguucccccauguggucaucgaugugaggacauuggacccugugcggcucccacugcccgauguccgcucaaccuuuuuccacuauacuaacgacacagagccuaaaaugcgacugguuauauggcucuacaccccauuacguacuaauggcagcggggaugacaguuuuacaguguccggaagaauccugaccaggcccucucaggauuucgaauuugcauuccuuauuccgccuacgguagagacuaagaccacacccuuuagcgugccagguuucuccguccaggaaaugucaaacagucgguggccugcugccaucagcgcgauggugguucgcggcaaugagccccaagugguccaguuucagaacgggagagcccauuuggacggaaugcugcuaggcacuaccccagugucucccaauuauauugcauccuacagggguaucucaacagggaacagccggagugcuucuuccgaggccgaugaacgcgcuguaggcagcuucgacguuugggugcgacuccaggagccugacggacaaccauaugauauauucggcaagcagccggcccccauugggaccccugacuuuaaagcagucaucgugggauucgccgcuagaccacugacgucggguucuuacgcgaacgaagcauacgucaauacuacagccuccgauuaugcucccgccaccggcaacaugagguuuacugugcggaaugggggaacaggccacauuucagcaaacaaguacugggaguucaaaaguuuugguguugaaggggagggccauaccaauauccaguaucaagaguacgaacuuccugacuauagcggacagguggccuccaaccacaaucuggcuccacccguagccccgcguaugccuggcgagucuuugcuccuguuccagagcucaaugccagucugggaugacgggcacggagaaaguacgcccaagaaaauccauugcuuacugccucaggaguuuauuggucacuucuuugauaagcaagcacccucccucggcgacgcggcccuucugcgcuacgugaaccaggaaaccaauagaguuuuguucgaguguaagcuauauagggauggguacauaacaguggcugcaagcucuggacugcucgacuuuccacuggauggcuucuuucgguucgacucaugggucaguagcuucuacauccuuuccccuguggguucugggcagggccgacgcuga

SEQ ID NO: 20019 - RNA, 1653 nt, Artificial Sequence
  derived and/or modified sequence opt3 from VP1__Norovirus_and/or_Norovirus-like__AF195847
augaagauggccagcuccgacgcugcacccucugccgauggcgcggggaaccuggugccugagucacagcaagaaguccucccacuugcuccgguugccggagcagcccuggcugcacccgugguaggucagaccaauaucauugacccuuggauaaaagagaacuucgugcaggccccacagggcgaauuuacagucagucccaagaauagcccuggggagaucuuggugaacuuagaacugggaccaaaacuaaaucccuaccucgaucaccuguccagaauguauaacucuuacgcuggcgguauugacguuauggugguccuugccgggaaugcguucacugcaggaaaggugcugaucgccgcuauuccuccaaacuuuccgguagagggcguuucggccucacaagcaacgcaguucccccaugugaucauagaugucaggaccuuggacccugugcggcucccacugcccgaugugcgcagcacauuuuuccacuauacuaaugacaccgagccuaaaaugcgacuggucaucuggcucuacacaccauuacguaccaacggcaguggggaugacuccuuuacuguuucuggaaggauucugacaagacccagccaggauuucgaauuugcuuuccuuaucccgccuaccguggagacgaagacuacccccuuuuccguaccagguuucucagugcaggaaaugaguaauagccgguggccugccgcgauuucugccauggucgugcgcggcaacgagccccaaguugugcaguuucagaaugggagagcacauuuggacggaaugcugcuaggcacaacuccagucucccccaacuauaucgcuucauacagggguauaagcaccgggaauagucggucugccuccccugaggcugaugaacgcgccgugggcagcuucgacguauggauucgacuccaggagccagacggacaaccguaugauaucuucggcaagcagcccgcaccuauugggacaccagacuuuaaagccguuaucgugggauucgcugcgagaccccugaccucggguucuuacgcaaacgaagccuacgucaacacgacugcuuccgauuaugccccugcaacaggcaauaugagguuuaccgugcggaacgggggaucaggccacaucagugccaauaaguacugggaguucaaauccuuuggugucgaaggggagcgucauacugacauucaguaucaagaguacgaacuuccagauuauagcggccagguggcuucuaaccacaaucuggcacccccgguugccccucgcaugccaggagagagcuugcuccuguuccagucaaacaugcccgugugggacgauggccacggggaaaguacaccuaagaaaauacauugcuuacugccccaggaguuuaucggacacuucuuugacaagcaagcgccaucccucggugaugcugcccuucugagauacguaaaucaggaaaccaacagggucuuguucgaguguaagcuauaucgggacggcuacauuacgguggcagccagcucugggcugcucgauuuuccucuggacggauucuuucgauucgacucauggguuaguagcuucuacauccuuucccccgugggcucuggucaggggcgcagauga

SEQ ID NO: 20020 - RNA, 1653 nt, Artificial Sequence
  derived and/or modified sequence opt3 from VP1__Norovirus_and/or_Norovirus-like__JQ970479
augaagauggccagcuccgacgcugcacccucugccgauggcgcggggaaccuggugccugagucacagcaagaaguccucccacuugcuccgguugccggagcagcccuggcugcacccgugguaggucagaccaauaucauugacccuuggauaaaagagaacuucgugcaggccccacagggcgaauuuacagucagucccaagaauagcccuggggagaucuuggugaacuuagaacugggaccaaaacuaaaucccuaccucgaucaccuguccagaauguauaacucuuacgcuggcgguauugacguuauggugguccuugccgggaaugcguucacugcaggaaaggugcugaucgccgcuauuccuccaaacuuuccgguagagggcguuucggccucacaagcaacgcaguucccccaugugaucauagaugucaggaccuuggacccugugcggcucccacugcccgaugugcgcagcacauuuuuccacuauacuaaugacaccgagccuaaaaugcgacuggucaucuggcucuacacaccauuacguaccaacggcaguggggaugacuccuuuacuguuucuggaaggauucugacaaggcccagccaggauuucgaauuugcuuuccuuaucccgccuaccguggagacgaagacuacccccuuuuccguaccagguuucucagugcaggaaaugaguaauagccgguggccugccgcgauuucugccauggucgugcgcggcaacgagccccaaguugugcaguuucagaaugggagagcacauuuggacggaaugcugcuaggcacaacuccagucucccccaacuauaucgcuucauacagggguauaagcaccgggaauagucggucugccuccagcgaggcugaugaacgcgccgugggaucguucgacguauggauucgacuccaggagccugacggccaaccauaugauaucuucggcaagcagccggcacccauugggacaccugacuuuaaagccguuaucgugggauucgcugcgagaccacugaccucugguuccuacgcaaacgaagccuacgucaacacgacugcuucagauuaugcccccgcaacaggcaauaugagguuuaccgugcggaacgggggaacuggccacaucagugccaauaaguacugggaguuccguagcuuuggugucgaaggggagcgccauacagacgugcaguaucaagaguacgaacuuccugauuauuccggccagguugcuucuaaccacaaucuggccccacccguggcaccgagaaugccuggagagagcuugcuccuguuccagucaaacaugccaguaugggacgauggcagaggggaaaguacccccaaaaagauucacugcuuacugccucaggaguuuauaggacauuucuuugacaaacaagcgcccucccucggugaugcugcccuucugcgguacgucaaucaggaaacgaaccgaguguuguucgaguguaagcuauaucgcgacggcuacaucaccguugcagccgcuagcgggcugcucgauuuuccacuggacggauucuuuagauucgacucuugggugucaaguuucuacauucuuagcccugucggcuccggucaggggaggcgguga

SEQ ID NO: 20021 - RNA, 1653 nt, Artificial Sequence
  derived and/or modified sequence opt3 from VP1__Norovirus_and/or_Norovirus-like__FM865412
augaagauggccagcuccgacgcugcacccucuaccgauggcgccgggaaccuggugccugagucacagcaagaaguccucccacuugcgccgguugcuggagccgcacuggccgcucccgugguaggucagacaaauaucauugacccuuggauaaaagagaacuucgugcaggcaccacagggcgaauuuacugucagucccaagaauagcccuggggagaucuuggugaacuuagaacugggaccaaaacuaaaucccuaccucgaucaccuguccagaauguauaacucuuacgccggcgguauugacguuauggugguccuugcugggaaugccuucacggcgggaaaggugcugaucgcagccauuccuccaaacuuuccgguagagggcguuucggcuucacaagccacccaguucccccaugugaucauagaugucaggacauuggacccugugcggcucccacugcccgaugugcgcagcaccuuuuuccacuauacuaaugacacagagccuaaaaugcgacuggucaucuggcucuacaccccauuacguacuaacggcaguggggaugacuccuuuacaguuucuggaaggauucugaccagacccagccaggauuucgaauuugcauuccuuaucccgccuacgguggagacuaagaccacacccuuuuccguaccagguuucucagugcaggaaaugaguaauagccgguggccugcugccauuucugcgauggucgugcgcggcaacgagccccaaguugugcaguuucagaaugggagagcccauuuggacggaaugcugcuaggcacuaccccagucucccccaacuauaucgcaucauacagggguauaagcacagggaauagucggucugcuuccagcgaggccgaugaacgcgcugugggaucguucgacguauggguucgacuccaggagccugacggccaaccauaugauauuuucggcaagcagccggcccccaucgggaccccugacuuuaaagcagugauugucggauucgccgcuagaccacugacgucugguuccuacgcgaacgaagcauacgugaacacuacagccucagauuaugcucccgccaccggcaauaugagguuuacuguccggaacgggggaacaggccacaucagugcaaauaaguacugggaguucaaauccuuugguguggaaggggagcgucauaccaacauccaguaucaagaguacgaacuuccugacuauagcggccagguugccucuaaucacaaccuggcuccacccguggccccgcgcaugccuggagagagcuugcuccuguuccagucaaauaugccaguaugggaugacggccacggggaaaguacgcccaagaaaauucauugcuuacugccucaggaguuuauaggacacuucuuugauaagcaagcacccucccucggugacgcggcccuucugagauacgucaaccaggaaaccaauaggguguuguucgaguguaagcuauaucgggauggcuacaucacaguugcugcaagcucugggcugcucgacuuuccacuggauggauucuuucgauucgacucaugggugaguagcuucuacauucuuuccccugucggcucuggucaggggcgcagauga

SEQ ID NO: 20022 - RNA, 1653 nt, Artificial Sequence
  derived and/or modified sequence opt3 from VP1__Norovirus_and/or_Norovirus-like__AF414426
augaagauggccagcuccgacgcugcacccucuaccgauggcgccgggaaccuggugccugagucacagcaagaaguccucccacuugcgccgguugcuggagccgcacuggccgcucccgugguaggucagacaaauaucauugacccuuggauaaaagagaacuucgugcaggcaccacagggcgaauuuacugucagucccaagaauagcccuggggagaucuuggugaacuuagaacugggaccaaaacuaaaucccuaccucgaucaccuguccagaauguauaacucuuacgccggcgguauugacguuauggugguccuugcugggaaugccuucacggcgggaaaggugcugaucgcagccauuccuccaaacuuuccgguagagggcguuucggcuucacaagccacccaguucccccaugugaucauagaugucaggacauuggacccugugcggcucccacugcccgaugugcgcagcaccuuuuuccacuauacuaaugacacagagccuaaaaugcgacuggucaucuggcucuacaccccauuacguacuaacggcaguggggaugacuccuuuacaguuucuggaaggauucugaccagacccagccaggauuucgaauuugcauuccuuaucccgccuacgguggagacuaagaccacacccuuuuccguaccagguuucucagugcaggaaaugaguaauagccgguggccugcugccauuucugcgauggucgugcgcggcaacgagccccaaguugugcaguuucagaaugggagagcccauuuggacggaaugcugcuaggcacuaccccagucucccccaacuauaucgcaucauacagggguauaagcacagggaauagucggucugcuuccagcgaggccgaugaacgcgcugugggaucguucgacguauggguucgacuccaggagccugacggccaaccauaugauauuuucggcaagcagccggcccccaucgggaccccugacuuuaaagcagugauugucggauucgccgcuagaccacugacgucugguuccuacgcgaacgaagcauacgugaacacuacagccucagauuaugcucccgccaccggcaauaugagguuuacuguccggaacgggggaacaggccacaucagugcaaauaaguacugggaguucaagagcuuugguguggaagggaaacgucauaccuccauccaguaucaagaguacgagcuuccugacuauucuggccagguugccagcaaccacaaucuggcuccacccguggccccgcgcaugccuggagaaucauugcuccuguuccagaguaacaugccaguaugggaugacggccacggggaguccacgcccaaaaagauucauugcuuacugccucaggaauuuauaggacacuucuuugauaagcaagcacccagccucggugacgcggcccuucugagauacgucaaucaggagaccaacaggguguuguucgaauguaaacuauaucgggauggcuacaucacaguugcugcaucuucagggcugcucgacuuuccacuggauggauucuuucgauucgacaguugggugagcuccuucuacauucuuucuccugucggcucgggucaggggcgcagauga

SEQ ID NO: 20023 - RNA, 1653 nt, Artificial Sequence
  derived and/or modified sequence opt3 from VP1__Norovirus_and/or_Norovirus-like__AF414427
augaagauggccagcuccgacgcugcacccucugccgauggcgcggggaaccuggugccugagucacagcaagaaguccucccacuugcuccgguugccggagcagcccuggcugcacccgugguaggucagaccaauaucauugacccuuggauaaaagagaacuucgugcaggccccacagggcgaauuuacagucagucccaagaauagcccuggggagaucuuggugaacuuagaacugggaccaaaacuaaaucccuaccucgaucaccuguccagaauguauaacucuuacgcuggcgguauugacguuauggugguccuugccgggaaugcguucacugcaggaaaggugcugaucgccgcuauuccuccaaacuuuccgguagagggcguuucggccucacaagcaacgcaguucccccaugugaucauagaugucaggaccuuggacccugugcggcucccacugcccgaugugcgcagcacauuuuuccacuauacuaaugacaccgagccuaaaaugcgacuggucaucuggcucuacacaccauuacguaccaacggcaguggggaugacuccuuuacuguuucuggaaggauucugacaagacccagccaggauuucgaauuugcuuuccuuaucccgccuaccguggagacgaagacuacccccuuuuccguaccagguuucucagugcaggaaaugaguaauagccgguggccugccgcgauuucugccauggucgugcgcggcaacgagccccaaguugugcaguuucagaaugggagagcacauuuggacggaaugcugcuaggcacaacuccagucucccccaacuauaucgcuucauacagggguauaagcaccgggaauagucggucugccuccacagaggcugaugaacgcgccgugggcagcuucgacguauggauucgacuccaggagccugacggacaaccauaugauaucuucggcaagcagccggcacccauugggaccccugacuuuaaagccguuaucgugggauucgcugcgagaccacugacgucggguucuuacgcaaacgaagccuacgucaacacuacagcuuccgauuaugcccccgcaaccggcaauaugagguuuacugugcggaacgggggaucaggccacaucagugccaauaaguacugggaguucaaauccuuuggugucgaaggggagcgucauacagacauucaguaucaagaguacgaacuuccugauuauagcggccagguggcuucuaaccacaaucuggccccacccguugcaccgcgcaugccuggagagagcuugcuccuguuccagucaaacaugccagugugggacgauggccacggggaaaguacccccaagaaaauacauugcuuacugccucaggaguuuaucggacacuucuuugacaagcaagcgcccucccucggugaugcugcccuucugagauacguaaaucaggaaacgaacagggucuuguucgaguguaagcuauaucgggacggcuacauuaccguggcagccagcucugggcugcucgauuuuccacuggacggauucuuucgauucgacucauggguuaguagcuucuacauccuuuccccugugggcucuggucaggggcgcagauga

SEQ ID NO: 20024 - RNA, 1653 nt, Artificial Sequence
  derived and/or modified sequence opt3 from VP1__Norovirus_and/or_Norovirus-like__JQ613567
augaagauggccagcuccgacgcugcacccucuaccgauggcgccgggaaccuggugccugagucacagcaagaaguccucccacuugcgccgguugcuggagccgcacuggccgcucccgugguaggucagacaaauaucauugacccuuggauaaaagagaacuucgugcaggcaccacagggcgaauuuacugucagucccaagaauagcccuggggagaucuuggugaacuuagaacugggaccaaaacuaaaucccuaccucgaucaccuguccagaauguauaacucuuacgccggcgguauugacguuauggugguccuugcugggaaugccuucacggcgggaaaggugcugaucgcagccauuccuccaaacuuuccgguagagggcguuucggcuucacaagccacccaguucccccaugugaucauagaugucaggacauuggacccugugcggcucccacugcccgaugugcgcagcaccuuuuuccacuauacuaaugacacagagccuaaaaugcgacuggucaucuggcucuacaccccauuacguacuaacggcaguggggaugacuccuuuacaguuucuggaaggauucugaccagacccagccaggauuucgaauuugcauuccuuaucccgccuacgguggagacuaagaccacacccuuuuccguaccagguuucucagugcaggaaaugaguaauagccgguggccugcugccauuucugcgauggucgugcgcggcaacgagccccaaguugugcaguuucagaaugggagagcccauuuggacggaaugcugcuaggcacuaccccagucucccccaacuauaucgcaucauacagggguauaagcacagggaauagucggucugcuuccagcgaggccgaugaacgcgcugugggaucguucgacguauggguucgacuccaggagccugacggccaaccauaugauauuuucggcaagcagccggcccccaucgggaccccugacuuuaaagcagugauugucggauucgccgcuagaccacugacgucugguuccuacgcgaacgaagcauacgugaacacuacagccucagauuaugcucccgccaccggcaauaugagguuuacuguccggaacgggggaacaggccacaucagugcaaauaaguacugggaguucaaauccuuugguguggaaggggagcgucauaccgacauccaguaucaagaguacgaacuuccugauuauagcggccagguugccucuaaccacaaucuggcuccacccguggccccgcgcaugccuggagagagcuugcuccuguuccagucaaacaugccaguaugggacgauggccacggggaaaguacgcccaagaaaauucauugcuuacugccucaggaguuuauaggacacuucuuugacagacaagcacccucccucggugaugcggcccuucugagguacgucaaucaggaaaccaaccggguguuguucgaguguaagcuauaucgagacggcuacaucacaguugcugcaagcucugggcugcucgauuuuccacuggacggauucuuucgcuucgacucaugggugaguagcuucuacauucuuuccccugucggcucuggucaggggagaagguga

SEQ ID NO: 20025 - RNA, 1653 nt, Artificial Sequence
  derived and/or modified sequence opt3 from VP1__Norovirus_and/or_Norovirus-like__KC894731
augaagauggccagcuccgacgcugcacccucuaccgauggcgccgggaaccuggugccugagucacagcaagaaguccucccacuugcgccgguugcuggagccgcacuggccgcucccgugguaggucagacaaauaucauugacccuuggauaaaagagaacuucgugcaggcaccacagggcgaauuuacugucagucccaagaauagcccuggggagaucuuggugaacuuagaacugggaccaaaacuaaaucccuaccucgaucaccuguccagaauguauaacucuuacgccggcgguauugacguuauggugguccuugcugggaaugccuucacggcgggaaaggugcugaucgcagccauuccuccaaacuuuccgguagagguugugucggcuucacaagccacccaguucccccaugucaucauagaugugaggacauuggacccugugcggcucccacugcccgauguccgcagcaccuuuuuccacuauacuaaugacacagagccuaaaaugcgacugguuaucuggcucuacaccccauuacguacuaacggcaguggcgaugacuccuuuacagugucugggaggauucugaccagacccagccaggauuucgaauuugcauuccuuaucccgccuacgguagagacuaagaccacacccuuuuccgugccaggauucucaguccaggaaaugaguaauagccgguggccugcugccauuucugcgauggugguucgcgguaacgagccccaagugguccaguuucagaauggcagagcccauuuggacgggaugcugcuaggaacuaccccagugucccccaacuauaucgcaucauacaggggcauaagcacagguaauagucggucugcuuccccugaggccgaugaacgcgcuguagggagcuucgacguuugggugcgacuccaggagccagacggacaaccguaugauauuuucggcaagcagcccgccccuaucggcaccccagacuuuaaagcagucauugugggguucgccgcuagaccccugacgucgggaucuuacgcgaacgaagcauacgucaacacuacagccuccaauuaugcuccugccaccgguaacaugagguuuacugugcggaauggcgggacaggacacaccucagcaaacaaguacugggaguucaaaaguuuuggcguugaaggugagcgucauacggggauccaguaucaagaguacgaacuuccagauuauagcggccagguggccuccaaucacaaccuggcucccccgguagccccucgcaugccaggagagucuuugcuccuguuccagagcaauaugcccgucugggacgauggccacggggaaucaaccccuaagaaaauccauugcuuacugccccaggaguuuauuggacacuucuuugacaagcaagcaccaagucucggugaugcggcccuucugagauacgugaaccaggaaacaaauaggguuuuguucgaguguaagcuauaucgggacggcuacauaacuguggcugcauccagcgggcugcucgauuuuccucuggacggauucuuucgauucgauucuugggucucaaguuucuacauccuuagccccgugggcuccggucaggggcgcagauga

SEQ ID NO: 20026 - RNA, 1647 nt, Artificial Sequence
  derived and/or modified sequence opt3 from VP1__Norovirus_and/or_Norovirus-like__AF427118
augaagauggccagcaacgacgcugcacccuccucugauggcgccgcggggcuggugccugagucaaauaacgaagucauggcucucgagccaguugccggagcaagucuugccgcuccggugaccggucagacaaauaucauugaccccuggauaagaaugaacuucguacaagcaccuaauggcgaauuuacugugagcccaaggaacucccccggggagguccuguugaauuuagaacugggaccugagcuaaacccauaccucgcccaccugucucggauguauaauggcuacgcuggugggauggaggugcagaucaugcuugccggaaacgcguucacggcaggcaaacugauuuuugccgcuguucccccucauuucccaaucgaaaauuugucgccgccccagauuaccauguuuccucacgugaucauagauguccgcacacucgagccagugcugcugcccaugccugacauccgaaacucauucuuucauuucauucagcgugaugaaccaaagaugagacucguagccauguuauauacuccccugaggagcaauggcaguggggacgauguuuuuaccguguccugccggguccuuacacgcccgaccccugacuucgauuuuacuuacuuggugcccccaacaguggagucuaaaagcaagccuuucacccugcccauccuaacgcucggagagcugacuaacuccagauuuccacuucccauugacguccuguauaccaauccuaacgaaucagcaaucguucaaugucagaacgguaggugcacauuggauggcgagcuccaggggacuacccagcuguuaccaacaggaauaugugcuuuccggggcaaagugacccaacagguacaggacgaacaccgcgguacgcauuggaauaugacugugacaaaccugaaugggaccccguucgaucccacugaggacgucccugccccacucggaacacccgacuuuaguggccagauuuacggcgugaucagccaacgaaacaccaauacgguuccuggggaaggagaucuuccagcgaacagagcccacgaggcagugauugcuaccuauucucccaaguucacaccgaagcuggguaauauccaguuuuccacuugggagacccaggacgucucaagcggccaaccuacaaaauucacuccagugggguuggccaguguagaugcuaacucucacuuugaccaguggacccuacccuccuacagcggagcccugacacucaauaugaaccuggcaccuucgguugcccccguguucccaggcgaaugccuucuguuuuucaggucuuuuaucccuuugaaggguggguacggcaaucccgcuauugauugucucaugccacaggaguggguccagcaucuguaucaagaauccgcgccgucauuaagugacguggcacugguccgguacgugaacccugagaccggacguacucuauucgaagccaaacuccaccgcaauggcuuucugacgguugcuagaaacagcgccgggcccgugguagcaccaacaaauggauauuucagguuugauuccugggucaaccaguucuacacccuugcccccauggguaacggcucugggcggcgacgcaugcaguga

SEQ ID NO: 20027 - RNA, 1647 nt, Artificial Sequence
  derived and/or modified sequence opt3 from VP1__Norovirus_and/or_Norovirus-like__AY237415
augaagauggccagcaacgacgcugcacccuccucugauggcgccgcggggcuggugccugagucaaauaacgaagucauggcucucgagccaguugccggagcaagucuugccgcuccggugaccggucagacaaauaucauugaccccuggauaagaaugaacuucguacaagcaccuaauggcgaauuuacugugagcccaaggaacucccccggggagguccuguugaauuuagaacugggaccugagcuaaacccauaccucgcccaccugucucggauguauaauggcuacgcuggugggauggaggugcagaucaugcuugccggaaacgcguucacggcaggcaaacugauuuuugccgcuguucccccucauuucccaaucgaaaauuugucgccgccccagauuaccauguuuccucacgugaucauagauguccgcacacucgagccagugcugcugcccaugccugacauccgaaacucauucuuucauuucauucagcgugaugaaccaaagaugagacucguagccauguuauauacuccccugaggagcaauggcaguggggacgauguuuuuaccguguccugccggguccuuacacgcccgaccccugacuucgauuuuacuuacuuggugcccccaacaguggagucuaaaagcaagccuuucacccugcccauccuaacgcucggagagcugacuaacuccagauuuccacuucccauugacguccuguauaccaauccuaacgaaucagcaaucguucaaugucagaacgguaggugcacauuggauggcgagcuccaggggacuacccagcuguuaccaacaggaauaugugcuuuccggggcaaagugacccaacagguacaggacgaacaccgcgguacgcauuggaauaugacugugacaaaccugaaugggaccccguucgaucccacugaggacgucccugccccacucggaacacccgacuuuaguggccagauuuacggcgugaucagccaacgaaacaccaauacgguuccuggggaaggaaaccuuccagcgaauagagcccacgaggcagugauugcuaccuauucucccaaguucacaccgaagcuggguaacauccaguuuuccacuugggagacccaggaugucucaagcggccaaccuacaaaauucacuccagugggguuggccaguguagacgcuaauucucacuuugaucaguggacccuacccuccuacagcggagcccugacacucaacaugaaucuggcaccuucgguugcccccguguucccaggcgaaugccuucuguuuuucaggucuuuuaucccuuugaaggguggguacggcaaccccgcuauugacugucucaugccacaggaguggguccagcaucuguaucaagaauccgcgccgucauuaagugauguggcacugguccgguacgugaauccugagaccggacguacucuauucgaagccaaacuccaccgcaacggcuuucugacgguugcuagaaauagcgccgggcccgugguagcaccaacaaacggauauuucagguuugacuccugggucaaccaguucuacacccuugcccccauggguaauggcucugggcggcgacgcaugcaguga

SEQ ID NO: 20028 - RNA, 1647 nt, Artificial Sequence
  derived and/or modified sequence opt3 from VP1__Norovirus_and/or_Norovirus-like__AF504671
augaagauggccagcaacgacgcugcacccuccaaugauggcgccgcggggcuggugccugagucuaacaaugaagucauggcucucgagccaguugccggagcaucacuugccgcuccggugaccggucagacaaacaucauugaccccuggauaagaaugaauuucguacaagcaccuaacggcgaauuuacugugaguccaaggaauagccccggggagguccuguugaacuuagaacugggaccugagcuaaauccauaccucgcccaccugucccggauguauaacggcuacgcuggugggauggaggugcagaucaugcuugccggaaaugcguucacggcaggcaaacugauuuuugccgcuguucccccucauuucccaaucgaaaacuugucuccgccccagauuaccauguuuccucacgugaucauagauguccgcacacucgagccagugcugcugcccaugccugacauccgaaauucguucuuucauuucauucagcgugaugaaccaaagaugagacucguagccauguuauauacuccccugaggucaaacggcagcggggacgauguuuuuaccgugaguugccggguccuuacacgcccgaccccugacuucgauuuuacuuacuuggugcccccaacaguggaguccaaaucuaagccuuucacccugcccauccuaacgcucggagagcugacuaauagcagauuuccacuucccauugacguccuguauaccaacccuaacgaauccgcaaucguucaaugucagaaugguaggugcacauuggauggcgagcuccaggggacuacccagcuguuaccaacaggaauaugugcuuuccggggcaaagugacccaacagguacaggacgaacaccgcgguacgcauuggaacaugacugugacaaaucugaacgggaccccguucgaucccacugaggacgucccugccccacucggaacacccgacuuuucaggccagauuuacggcgugaucagucaacgaaauaccaacacgguuccuggggaaggaaaucuuccagcgaacagagcccacgaggcagugauugcuaccuauagccccaaguucacaccgaagcuggguaauauccaguuuucuacuugggagacccaggaugucuccucaggccaaccuacaaaauucacuccagugggguuggccagcguagacgcuaacagucacuuugaucaguggacccuacccucuuacuccggagcccugacacucaauaugaaccuggcaccuagcguugcccccguguucccaggcgaaugccuucuguuuuucaggucguuuaucccuuugaaggguggguacggcaaucccgcuauugacugucucaugccacaggaguggguccagcaucuguaucaagaaucugcgccguccuuaucagauguggcacugguccgguacgugaacccugagaccggacguacucuauucgaagccaaacuccaccgcaauggcuuucugacgguugcuagaaacagugccgggcccgugguagcaccaacaaacggauauuucagguuugacagcugggucaaucaguucuacacccuugcccccauggguaacggcuccgggcggcgacgcaugcaguga

SEQ ID NO: 20029 - RNA, 1647 nt, Artificial Sequence
  derived and/or modified sequence opt3 from VP1__Norovirus_and/or_Norovirus-like__KJ194504
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugguugccaugcuguacacaccccucagagcaaauaacucuggagaugacguguucaccgucucguguaggguguuaacucggccuucaccagauuuuagcuucaauuuucuggugcccccgaccgucgagaguaagacaaaaccuuucacccuucccauuuugacuaucuccgaaaugucuaacagccgcuuuccaguuccuauagacucccugcauacaucacccaccgagaauauugugguacagugccagaacgguagagugacgcuagauggcgagcucauggggacuacccaacugcuuccaagucagaucugugcuuucaggggaacacugacucggagcaccucucgcgccuccgaccaggcugauacacccaccccucgacaguucgaccacagauggcauauucaauuggacaaucucaacggcacgccauaugauccggccgaagacauccccgcaccucuggguacuccagauuuuagggggaaggucuucggaguggccucacagcggaaucccgacggcacaacccgugcucacgaggcgaaaguugauacuacaaccaaccgcuuuacgccuaaguuaggcagccuggaaaucauuaccgagagugaagacuucgauacaaaucagucuacuaaguuuaccccagugggggucggaguggacaacgaggaggaguuccaacaguggucccuccccaauuacagcggucaguuuacacacaacaugaaucuugcaccggccguagcuccuaacuucccaggcgaacagcuguuguuuuucagaucgcaacuacccucuuccgggggauggucaaacggcauacuggauugccucguuccucaggaaugggugcagcauuuuuaucaggagagugcccccgcacaaacucaggucgcccuggugagguacgucaauccagacaccggucgggugcuuuucgaagcuaaacugcacaaguugggguuuaugacaaucgccaaaaacggcgauagcccuauuaccguucccccaaauggauacuuccgauucgaguccugggugaacccguuuuauacucucgcaccuaugggcacggggaauggacgcagaaggauccaguga

SEQ ID NO: 20030 - RNA, 1647 nt, Artificial Sequence
  derived and/or modified sequence opt3 from VP1__Norovirus_and/or_Norovirus-like__KJ194500
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaguuuagaacugggcccugagaucaacccauaccuagcccaccucgcgaggauguauaaugguuacgcagggggauucgaggugcaggucgugcuggccggcaacgcuuuuacugccggcaaaauuaucuucgcagcuauacccccuaauuuuccaaucgauaaccuuagcgccgcgcagauuacgaugugcccgcauguuaucguggacguccggcaacuggaacccgugaauuugccuaugccagauguacgcaacaauuucuuucacuauaaccaguccucugagucgcgacuccgucugauugccaugcuguacacaccccucagagcaaacaauucaggggacgauguuuucaccgugagcuguagggucuuaacucggccuaguccagacuuuuccuucaacuuucuggugcccccgaccguggaaucuaagacaaaaccuuucacccuucccaucuugacuauaagcgagauguccaauucacgcuuuccagucccuauugauagucugcauacaagccccaccgagaacaucguugugcagugccagaauggaagaguaacgcuagacggugaacucaugggcacuacccaacugcuuccaucucagauuugugcuuucagggggacacugacuggauccaccucacgggccagcgaucagacagacacccccacgccucgccaguucgaucgaagauggcacauccaauuggacaaccucaauggcacuccauaugacccggcugaggauauccccgccccucuggguacaccagacuuuagggggaagguguucggagucgcaagucagcggaaccccgaucgugccacccgcgcucaugaagcgaaaguggacacuacaucugauagauuugcaccuaaguuaggcucccuggagauuaccacggaaagcggcgacuucgaggccaaucagccaaccaaguuuacacccguugggauaggaguggauaacgaggcugaguuccaacaguggucgcucccgaauuacucuggucagaucacucacaacaugaaucuugccccugcagucgccccaaacuuucccggcgaacagcuguuguucuuuaggucccaacuaccuucaagugggggauggagcaauggcgugcuggacugccuccugccccaggaauggguacagcacuucuaucaggaguccgcuccagcccaaacccagguugcacuugugcgguacgucaacccugauacaggucgagugcuguuugaagcgaaauugcauaagcucggguucaugacuauugcuaaaaacggcgacucucccaucaccgucccaccgaauggauacuuucgcuucgagagcugggugaacccuuucuauacacuggcccccaugggcaccgggaauggaagaaggcggauacaguga

SEQ ID NO: 20031 - RNA, 1647 nt, Artificial Sequence
  derived and/or modified sequence opt3 from VP1__Norovirus_and/or_Norovirus-like__DQ093063
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgacaaucuuagugccgcgcagaucacgaugugcccgcaugugauugucgaugugcggcaacuggagcccaucaacuugccuaugccagacguacgcaauaacuucuuucacuauaaccaggggagcgauucccgacuccgucugauugccaugcuguacacaccccucagagcaaauaacucuggagacgauguuuucaccgugucguguagggucuuaacucggccuucaccagacuuuagcuucaauuuucuggugcccccgaccguggaaaguaagacaaaaccuuucacccuucccaucuugacuauauccgagaugucuaacagccgcuuuccagucccuauugauucccugcauacaucacccaccgaaaguguugugguacagugccagaaugguagagugacgcuagacggcgagcucauggggacuacccaacugcuuccaagccagaucugugcuuucaggggaacacugacucggcccaccaaccgcgccucugaucaggcugacacagccaccccucgauuguucaaucaccaguggcauauucaacucgacaaccugaauggcacgccauaugauccggcagaggacauccccgccccuuuagguacuccagauuuuagagggaaggucuucggaguggcuucccagagggaccccgauggcacaacccgggcgcacgaagcaaaaguugacacuacaucaggccguuuuaccccuaagcuggggagccucgagaucacgaccgaaagugaugacuucaaccagaauaagccaacacgcuuuacucccgugggaauuggugucgauaacgaggccgacuuccaacaguggauacuuccggauuacucuggccaguuuacccacaauaugaaccuggcuccugccguggcaccaaauuuccccggggaacaguugcuauuuuucagaucccaacugccuagcucgggaggcaggucuaacgguauccucgacugccugguaccccaggaguggguucagcauuuuuaucaggaguccgccccagcucaaacacagguggcccuuguccgguacgugaacccugacacugggcgaguccuguucgaagcaaaauugcacaagaugggcuuuaugaccauugcgaaaaauggagauucacccaucacagugccaccgaacggcuacuuccgcuucgagaguuggguuaauccuuuuuauacccucgcucccauggggacuggaaaggguagaaggcggauacaguga

SEQ ID NO: 20032 - RNA, 1647 nt, Artificial Sequence
  derived and/or modified sequence opt3 from VP1__Norovirus_and/or_Norovirus-like__AY030313
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgacaaucuuagugccgcgcagaucacgaugugcccgcaugugauugucgaugugcggcaacuggagcccaucaacuugccuaugccagacguacgcaauaacuucuuucacuauaaccaggggagcgauucccgacuccgucugauugccaugcuguacacaccccucagagcaaauaacucuggagacgauguuuucaccgugucguguagggucuuaacucggccuucaccagacuuuagcuucaauuuucuggugcccccgaccguggaaaguaagacaaaaccuuucacccuucccaucuugacuauauccgagaugucuaacagccgcuuuccagucccuauugauucccugcauacaucacccaccgaaaguaucguugugcagugccagaaugguagaguaacgcuagacggcgagcucauggggacuacccaacugcuuccaaaccagauuugugcuuucaggggaacacugacucggagcaccaaucgcgccucugaucaggcugacacagccacgccccgauuguucgaccaccauuggcacauccagcucgauaaccugaauggcaccccuuaugacccagcagaggauaucccggcccccuuagguacuccugacuuuagagggaagguguucggagucgcuucccaaaggaacccagauucaacaacccgggcgcacgaagcaaaaguggacacuacaagcggccguuuuacccccaagcugggcagucucgagauuacgaccgaaucugaugacuucgauccuaaucaguccacaaaguuuacuccaguugggauaggaguggacaacgaggccgauuuccagcaauggagccuucccgacuacucgggucaguuuacccauaauaugaaccuggcuccggccgucgcaccuaauuucccaggcgaacaguugcuauuuuuccgcucucagcugcccuccucagggggaagaaguaacggcauccucgacugccuggugccucaagaguggguacagcacuuuuaucaggagagcgcccccgcucagacacaaguugcccuugugagguacgucaacccagauacuggucgggugcuguucgaagcaaaauugcauaagcucggguuuaugaccauugcgaaaaauggcgacuccccuaucacagugcccccaaacggauacuuccgauucgagucuugggucaauccguuuuauacccuggcuccuaugggcacugggaacggacgcagaaggauacaguga

SEQ ID NO: 20033 - RNA, 1647 nt, Artificial Sequence
  derived and/or modified sequence opt3 from VP1__Norovirus_and/or_Norovirus-like__U02030
augaagauggccagcaacgacgcugcacccuccaaugauggcgccgcgugccuggugccugagaucaacaaugaagcuauggcccucgagccagucgcagggucugccauugcugcaccgcuuaccggacagcaaaacauaaucgaccccuggauuaugaauaacuucguucaggccccugguggcgaauuuacagugucaccaagaaauagucccggggagguacuguugaacuuagaacugggaccugagaucaauccauaccuagcucaccucgccaggauguauaacggcuacgcggguggguucgaggugcaggucgugcuggcaggaaaugccuuuacugcuggcaaaauuaucuucgccgcaauacccccuaacuuuccaaucgauaaucuuagcgcugcccagauuacgauguguccgcauguuaucguggacguccggcaacuggaacccauuaacuugccuaugccagaugugcgcaauaacuucuuucacuauaaccagggcuccgacucucgacuccgucugaucgcgaugcuguacacaccccucagagccaauaacucgggggaugacguauucaccguuucaugcaggguguuaacucggccuagcccagauuuuaguuucaauuuucuggugcccccgaccgucgaguccaagacaaaaccuuucacccuucccauauugacuauuucugaaaugagcaacucccgcuuuccagugccuaucgacucacugcauacaagucccaccgagaauauugucguucagugucagaacggaagagugacgcuagauggugagcucaugggcacuacccaacugcuuccaagccagaucugcgcauucagggggacacugacucggucuaccucccgcgcuucagaccaggccgauacacccaccccucgauuguucaauuauuacuggcacauccagcucgacaaccugaauggaacgccauaugacccggcugaagauauucccgccccuuuaggcacuccagacuuuagagguaagguauucgggguggcaagccaaaggaaccccgauaguacaacccgggcccaugaggcuaaagucgacacuacaucuggacguuuuaccccuaagcugggcucccucgaaauaacgaccgagagcgaugacuucgauccaaaucagcccacaaaguuuacuccggugggcguugggguggacaacgaagcggaguuccagcaauggucgcuuccuaauuacucuggacaguuuacccacaacaugaaucuggcaccagccgucgcucccaacuucccuggugagcaguugcuauuuuuccgcucccagcugcccucaaguggcgggagaagcaacggagugcucgauugucugguaccacaagaauggguucagcacuuuuaccaggaguccgccccugcacagacacaaguggcccuugucagguaugugaaucccgacacuggccggguccuguucgaagcuaaauugcauaagcucgguuuuaugaccaucgccaaaaacggggauucuccaauuacagugccgccuaauggcuacuuccgauucgagagcuggguuaaccccuuuuauacccuggcaccaaugggaacuggcaaugggcgcagaaggauccaguga

SEQ ID NO: 20034 - RNA, 1647 nt, Artificial Sequence
  derived and/or modified sequence opt3 from VP1__Norovirus_and/or_Norovirus-like__AB039782
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuaucccuccuaacuuuccaauagauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugacguuuucaccgugucguguagggucuuaacucggccuucaccagauuuuagcuucaauuuucuggugcccccgaccguggagaguaagacaaaacuuuucaccuugccuauccugacuauauccgaaaugucuaacagccgcuuucccgucccaauugacucccuacauacaucaccuaccgagaauaucguugugcagugccagaacgguagaguaacgcucgauggcgagcugauggggacuacccaacuucugcccagucagauuugugcuuucaggggaacauugacucggagcaccucucgcgccuccgaccaggcugauacaccaacgccccgacucuucaaucacagauggcauauccagcuggacaacuuaaauggcaccccuuaugacccagccgaagauaucccggcaccccuggguacuccugacuuuagggggaagguguucggagucgccucacaacggaacccagauagcacaacccgugcucacgaggcgaaaguggacacuacaaguggccgcuuuacccccaagcucggcucucuugaaauuacgaccgaguccgaugacuucgauacaaaucagagcacuaaguuuaccccuguugggauaggaguggacaacgaagcagaguuccagcaauggucgcugccaaauuacucuggucaguuuacacacaacaugaauuuggcccccgcugucgccccgaacuucccuggcgagcagcuacuguuuuucagaucccagcucccaucaagugggggaaggagcaacggcgugcuggauugccuuguaccccaagaauggguucagcauuuuuaucaggaguccgcacccgcccagacucaaguggcucugguccgguacgugaaucccgacaccggucgagucuuguucgaagccaaacuccacaagcugggguuuaugacaaucgcgaaaaacggcgauucuccaauuaccgugccucccaauggauacuuccgcuucgagagcuggguuaacccauuuuauacuuuagcaccgaugggcacggggaauggaagaaggcggauccaguga

SEQ ID NO: 20035 - RNA, 1647 nt, Artificial Sequence
  derived and/or modified sequence opt3 from VP1__Norovirus_and/or_Norovirus-like__U46039
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguucacaccccucagagcaaauaacucuggagaugacguuuuuaccgugucguguagggucuuaacucggccuucaccagauuucagcuuuaauuuccuggugcccccgaccguggagaguaagaucaaaccuuuuacacuucccauauugccaauuuccgaaaugucuaacagccgcuucccuguccccaucgacucccugcauaccucaccaacugagaauauuguugugcagugccagaacgguagaguaacacuagauggcgagcucauggggaccacgcaacuguuccccagucagaucugugcuuuuaggggaacucuuacccggagcacaucucgcgccuccgaccaggcugauacuucaaccccucgacuguucaauuacuauuggcacauccaguuggacaaccucaauggcacaccauacgacccggccgaagauauucccgcaccucuggguaccccagacuuucaagggaagguguucggagucgccagccagagaaaccccgauaguacgacuagggcucaugaggcgaaaguggacacaaccucuggccgguuuacuccuaaguuaggcucccuggaaauaagcacagagucggaugacuucgauucuaaucagccaaccaaguuuacgcccguugggaucggaguggacaacgaagcagauuuccaacaguggucccucccgaauuauucaggucaguuuacccacaacaugaaucuugccccugcugucgccccaauuuuccccggcgagcagauccuguuuuuccguagucaagugccuagcuccgggggacgcucuaacggcguauuggacugccuaguuccccaggagugggugcagcacuuuuaccaggaaagcgcaccagcccaaacacaggucgcucuggugagauacgucaacccugauacugguaggguucucuucgaggccaaacugcauaaacuuggguucaugaccauagcaaagaauggcgacucacccauuacagugccaccgaacggauauuuucgguucgaaaguugggugaauccuuuuuacacucuggcgcccaugggcaccgggaacggacgacgcagaauccaguga

SEQ ID NO: 20036 - RNA, 1647 nt, Artificial Sequence
  derived and/or modified sequence opt3 from VP1__Norovirus_and/or_Norovirus-like__DQ093066
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgacaaucuuagugccgcgcagaucacgaugugcccgcaugugauugucgaugugcggcaacuggagcccaucaacuugccuaugccagacguacgcaauaacuucuuucacuauaaccaggggagcgauucccgacuccgucugauugccaugcuguacacaccccucagagcaaauaacucuggagacgauguuuucaccgugucguguagggucuuaacucggccuucaccagacuuuagcuucaauuuucuggugcccccgaccguggaaaguaagacaaaaccuuucacccuucccaucuugacuauauccgagaugucuaacagccgcuuuccagucccuauugauucccugcauacaucacccaccgaaaauaucguugugcagugccagaacgguagaguaacgcuagacggcgagcucauggggacuacccaacugcuuccaagucagauuuguacauucaggggaacucugacccggagcacaucucgcgcuuccgaucaggccgacaccgcuacgccccgauuguucaauuauuacuggcacauccagcucgacaaccugaauggcacuccuuaugauccagccgaggacaucccggcacccuuagguacaccugauuuuagagggaagguguucggagucgccucacaaaggaacccagacagcaccacucgggcucaugaagcgaaaguggauacaaccaguggccguuuuauucccaagcugggcucucucgagauauccacggaaagcgacgauuucgaccagaaucagccuacccgcuuuacaccaguugggaucggaguggauaacgaggcagguuuccaacaguggucgcuucccgacuacucuggccaguuuacucacaauaugaaccuggccccggcugucgccccuaauuucccaggggaacaguugcuauuuuucagaucccaacugcccucaaguggaggcaggagcaacgguauucucgauugccuggugccucaggaguggguacagcacuuuuaccaggaguccgcacccgcccaaacccagguugcucuugugcgguaugucaacccagacacagggcgagugcuguucgaagccaaguugcauaaacucggcuuuaugacuaucucuaagaauggagacagcccuauaaccgugcccccaaacggcuacuuccgcuucgagucaugggucaauccguuuuauacacuggcaccuauggggaccggaaacgguagaaggcggauucaguga

SEQ ID NO: 20037 - RNA, 1647 nt, Artificial Sequence
  derived and/or modified sequence opt3 from VP1__Norovirus_and/or_Norovirus-like__DQ093062
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugacguuuucaccgugucguguagggucuuaacucggccuucaccagauuuuagcuucaauuuucuggugcccccgaccguggagaguaagacaaaacuuuucaccuugccuauccugacuauauccgaaaugucuaacagccgcuuucccgucccaauugacucccuacauacaucaccuaccgagaauaucguugugcagugccagaacgguagaguaacgcucgauggcgagcugauggggacuacccaacuucugcccagucagauuugugcuuucaggggaacauugacucggccaaccagccgcgccucugaccaggcugauacacccaccccucgacucuucaaucacagauggcauauccagcuggacaacuuaaauggcacgccauaugacccggccgaagauauccccgcaccucuggguacuccagacuuuagggggaagguguucggagucgccucccaacggaaccccgauucaacaacccgugcucacgaggcgaaaguggacacuacaagcggccgcuuuaccccuaagcucggcagucuugaaauuacgaccgagucugaugacuucgauacaaaucaguccacuaaguuuaccccaguugggauaggaguggacaacgaagcagaguuccagcaauggagccugcccaauuacucgggucaguuuacacacaacaugaauuuggccccggcugucgccccuaacuucccaggcgagcagcuacuguuuuucagaucucagcuccccuccucagggggaaggaguaacggcgugcuggauugccuuguaccucaagaauggguucagcauuuuuaucaggagagcgcacccgcccagacucaaguggcucuggucaaauacgugaauccagacaccggucgggucuuguucgaagccaagcuccacaaacugggguuuaugacaaucgcaaagaacggcgauuccccuauuaccgugcccccaaauggauacuuccgauucgagucuuggguuaacccguuuuauacuuuagcgccuaugggcacggggaauggacgcagaaggauccaguga

SEQ ID NO: 20038 - RNA, 1647 nt, Artificial Sequence
  derived and/or modified sequence opt3 from VP1__Norovirus_and/or_Norovirus-like__GU930737
augaagauggccagcaacgacgcugcacccuccaaugauggcgccgcgaaccuggugccugaggcuaauucugaagucauggcccucgagccaguugugggggcaucaaucgccgcuccgguagugggacagcaaaacauuauagaccccuggaucagagaaaauuucguccaggcaccucagggugaguuuaccgugaguccaaggaacagccccggcgaaaugcuucugaauuuggaguuagggccugagcugaacccauaccuaucccaccucucucggauguauaauggauacgccggcgguaugcagguucaagugguccuggcugggaacgccuucacagcgggaaagauuaucuuugcagccgugcccccucauuucccaguagaaaauauuucggcugcccagaucacuaugugcccgcacguuauaguggauguccgccagcuugagcccgugcuguugccucucccagacauccgaaacagauuuuuccauuauaaucaggaagauacgccccguaugaggcugguggcaaugcuguacaccccucuccgggcuaacucaggcgaggacgucuuuacaguuagcugucgcguguuaacuagaccagcccccgauuucgaguuuaccuuccugguaccgccuacaguggaaaguaagaccaaacccuuuacucuuccaauuuugacacugggcgagcuauccaauucuagguucccugcgcccaucgacaugcucuauaccgauccaaacgaagccauugucgugcaaccccagaacgggcggugcacgcuggacggaacucuucaggguaccacacagcugguuccuacucaaaucuguagcuuucgcggcaccuugauaucccagacaucacgaagugcagauagcaccgacucugcuccaagagugaggaaucacccgcuccauguccagcugaagaacuuagaugggacgcccuacgacccuacugacgaggugccagccguacugggagcuauugauuucaaaggcacaguuuucgguguggccucccaacggaauaccacugggaacucagaagagggagcaacacgugcccacgagguccacaucgacaccacgaauccccgcuauaccccuaagcucggcagcguguuuaugcauagugaaucuacagauuucgacgauggccagccaacuagauuuacccccauugggaugggagcugacgauuggaggcagugggagcuuccggaauacuccggucaccugacauugaacaugaaucuagcgccugcagucgccccagcuuuccccggcgagcggauccuguuuuuccgaagcgugguuccuucggccgggggauacggcucuggucagaucgacugccucauuccccaagaaugggugcagcauuuuuaucaggaggcagccccaucccagucagcuguagcccugauacgcuacgucaacccugauacugggagaaauaucuucgaggcaaaacuucacagggaaggcuuuauuaccguggcgaacaguggaaauaaccccaucguugugccaccgaauggcuauuuccgguuugaggcuugggucaaccaauucuacacacugaccccuauggggacuggacagggucgcagaagggugcaguga

SEQ ID NO: 20039 - RNA, 1647 nt, Artificial Sequence
  derived and/or modified sequence opt3 from VP1__Norovirus_and/or_Norovirus-like__AF414412
augaagauggccagcaacgacgcugcacccuccucugauggcgccgcggggcuggugccugagaucaauaacgaagcuauggcccucgagccagucgcaggagccgcuauugcagccccgcuuaccggucagcaaaauauaaucgaccccuggauuaugaacaauuucguucaggcuccuggcggggaauuuacagugucaccaagaaacagucccggagagguacuguugaauuuagaacugggcccugagaucaacccauaccuagcccaccucgcgaggauguauaaugguuacgcagggggauucgaggugcaggucgugcuggccggcaacgcuuuuacugccggcaaaguuauuuucgcagcuauacccccuaauuuuccaaucgauaaccuuagcgccgcgcagaucacgaugugcccgcaugugauugucgacgugcggcaacuggaacccaucaauuugccuaugccagauguacgcaacaauuucuuucacuauaaccagggguccgacucucgacuccgucugauugccaugcuguacacaccccucagagcaaacaauucgggagaugacguuuucaccgugucauguagggucuuaacucggccuagcccagauuuuaguuucaacuuucuggugcccccgaccguggaguccaagacaaaacuuuucaccuugccuauccugacuauaucugaaaugagcaauucccgcuuucccgucccaauugacucacuacauacaaguccuaccgagaacaucguugugcagugccagaaugguagaguaacgcucgauggcgagcugauggggacuacccaacuucugcccagccagauuugugcuuucaggggaacauugacucggucuaccucccgcgccucagaccaggcugauacaccaacgccccgacucuucaacuauuacuggcacauccagcuggacaauuuaaacggcaccccuuaugacccagccgaagauaucccggcaccccuggguacuccugacuuuagagggaagguguucggagucgccagccaaaggaauccagauaguacaacccgggcucaugaggcgaaaguggacacuacaucuggccguuuuacccccaagcucggcucccuugaaauuagcacggagucggaugacuucgauccuaaccagccaaccaaguuuacacccguugggauaggaguggacaaugaagcagauuuccagcaauggucucugccgaacuacuccggucaguuuacucacaauaugaacuuggccccugcugucgccccaaauuuccccggcgagcagcuacuguuuuuccgcucacagagaccuaguagcgggggaagguccaacggcauccucgacugccuggugccccaagaguggguacagcacuuuuaccaggaaucugcaccagcccagacccaaguugcucuugugcgguaugucaacccugauacaggucgagugcuguucgaggccaaauugcauaagcucggguuuaugacuauugcgaaaaauggcgacagccccaucaccgucccaccgaacggauacuuccgcuucgaaucaugggugaauccuuuuuauacacuggcacccaugggcaccgggaacggaagaaggcggauacaguga

SEQ ID NO: 20040 - RNA, 1647 nt, Artificial Sequence
  derived and/or modified sequence opt3 from VP1__Norovirus_and/or_Norovirus-like__AB039781
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugacguuuucaccgugucguguagggucuuaacucggccuucaccagauuuuagcuucaauuuucuggugcccccgaccguggagaguaagacaaaacuuuucaccuugccuauccugacuauauccgaaaugucuaacagccgcuuucccgucccaauugacucccuacauacaucaccuaccgagaauaucguugugcagugccagaacgguagaguaacgcucgauggcgagcugaugggggcuacucaacuucugcccagucagauuugugccuucaggggaaccuugacacggagcacuucucgcgcuuccgaccagaccgauacaccaacgccccgacucuucaaucacagauggcauauccagcuggacaacuuaaauggcaccccuuaugacccagccgaagauaucccggcaccccuggguacuccugacuuuagggggaagguguucggagucgccucacaacggaacccagauagcacaacccgugcucacgaggcgaaaguggacacuacaaguggccgcuuuacccccaagcucggcucucuugaaauuacgaccgaguccgaugaccuggauacaaaucagagcacuaaguucaccccuguugggauaggaguggacaacgaagcagaguuucagcaauggucguugccaaauuacucuggucaguucacacacaacaugaaucuagcccccgcugucgcccugaacuuuccgggcgagcagcuccuguucuuuagaucccagcuuccuucaagugggggaaggagcaacggcgugcuggauugcuugguaccacaagaauggguucagcauuucuaucaggaguccgcacccgcccagacucaaguggcucucguccgguacgugaauccugacaccggucgaguccuguuugaagccaaauuacacaagcugggguucaugacaaucgcgaaaaacggcgauucucccauuaccgugccaccuaauggauacuuucgcuucgagagcuggguuaaccccuucuauacucuagcaccaaugggcacggggaauggaagaaggcggauccaguga

SEQ ID NO: 20041 - RNA, 1647 nt, Artificial Sequence
  derived and/or modified sequence opt3 from VP1__Norovirus_and/or_Norovirus-like__LC035073
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugauugcgaugcuguacacaccccucagagccaauaacucuggagacgauguuuucacugugucguguagggucuuaacccggccuucaccagaauuuagcuucaauuuucuggugcccccgacaguggagaguaagaccaaaccuuucacucuucccaucuugacaauauccgaaaugucuaacagccgcuuuccagucccuauugacucccugcauaccucacccacggagaauaucguugugcagugccagaacgguagaguaacucuagauggcgagcucauggggaccacacaacugcuuccaagucagauuugugcauucaggggagugcugacucggagcaccucucgcgcuuccgaccaggccgauacagcuacgccccgauuguucaauuauuacuggcacauccagcucgacaaccugaauggcaccccuuaugacccagccgaagauaucccgggucccuuagggacuccugacuuuagaggaaaggucuucggcguggcaucacaaaggaacccagauagcacaacccgggcccaugaggcuaaaguugacacuacaaguggccguuuuacccccaagcuggggucucucgaaauuuccacggagagcgaugacuucgaucagaaucagccuacccgcuuuacaccagugggaauaggugucgaccacgaagcggauuuccaacaguggucgcuucccgacuacucuggccaguuuacucacaacaugaaucuggcaccggccguggcuccuaacuucccaggggagcaguugcuauuuuucagaucccaacugcccucaaguggaggcaggagcaaugguauccucgauugccugguaccucaggaguggguucagcauuuuuaccaggaauccgcccccgcacaaacccagguggcccuuguccgguaugugaacccagacacagggcgaguccuguucgaggcuaaguugcacaaacucggcuuuaugacuauugccaagaacggagacucuccuaucaccgugcccccaaauggcuacuuccgcuucgaaagcuggguuaacccguuuuauacacuggcaccuauggggaccggaaaugguagaaggcgggugcaguga

SEQ ID NO: 20042 - RNA, 1647 nt, Artificial Sequence
  derived and/or modified sequence opt3 from VP1__Norovirus_and/or_Norovirus-like__AF539440
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugauugcgaugcuguacacaccccucagagccaauaacucuggagacgauguuuucacugugucguguagggucuuaacccggccuucaccagacuuuagcuucaauuuucuggugcccccgacaguggaaaguaagaccaaaccuuucacucuucccaucuugacaauauccgagaugucuaacagccgcuuuccagucccuauugauucccugcauaccucacccacggaaaauaucguugugcagugccagaacgguagaguaacucuagacggcgagcucauggggaccacacaacugcuuccaagucagauuugugcauucaggggagugcugacucggagcaccucucgcgcuuccgaucaggccgacacagcuacgccccgauuguucaauuauuacuggcacauccagcucgacaaccugaauggcaccccuuaugauccagccgaggacaucccgggucccuuagggacuccugauuuuagaggaaaggucuucggcguggcaucacaaaggaacccagacagcacaacccgggcccaugaagcuaaaguugauacuacagcgggccguuuuacccccaagcuggggagucucgagauuucuacggaauccgacgauuucgaccagaaucagccuacccgcuuuacaccagugggagucgguguggaucacgaggcagacuuccaacaguggagccuucccgauuacucgggccaguuuacucacaacaugaaucuggccccggcuguagccccuaacuucccaggggaacaguugcuauuuuucagaucucaacugcccuccucaggaggcaggaguaaugguauacucgacugccugguuccucaggagugggugcagcauuuuuaccaggagagcgcacccgcccaaacccaggucgcucuugugcgguaugucaacccagacacagggcgagugcuguucgaagccaaguugcacaaacucggcuuuaugacuaucgcaaagaacggagauuccccuauuaccguucccccaaauggcuacuuccgcuucgagucuugggugaacccguuuuauacacuggcgccuauggggaccggaaaugguagaaggcggauccaguga

SEQ ID NO: 20043 - RNA, 1647 nt, Artificial Sequence
  derived and/or modified sequence opt3 from VP1__Norovirus_and/or_Norovirus-like__AF414414
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugacguuuucaccgugucguguagggucuuaacucggccuucaccagauuuuagcuucaauuuucuggugcccccgaccguggagaguaagacaaaacuuuucaccuugccuauccugacuauauccgaaaugucuaacagccgcuuucccgucccaauugacucccuacauacaucaccuaccgagaauaucguugugcagugccagaacgguagaguaacgcucgauggcgagcugauggggacuacccaacuucugcccagucagauuugugcuuucaggggaacauugacucggagcaccucucgcgccuccgaccaggcugauacaccaacgccccgacucuucaaucacagauggcauauccagcuggacaacuuaaauggcaccccuuaugacccagccgaagauaucccggcaccccuggguacuccugacuuuagggggaagguguucggagucgccucacaacggaacccagauagcacaacccgugcucacgaggcgaaaguggacacuacaaguggccgcuuuacccccaagcucggcucucuugaaauuauaacggaguccgaugacuucgauaccaaucagagcacaaaguuuacuccuguugggaucggaguggacaacgaaucggaguuccagcaauggucucugccaaauuacuccggucaguuuacccacaacaugaauuuggcacccgccgucgcuccgaacuuccuaggcgagcagcugcucuuuuucagaucacagcugccuaguagcgggggaagguccaacggcgugcuugauugccugguaccacaagaauggguucagcauuuuuaucaggagucugcccccgcacagacacaaguggccuugguccgguacgugaauccugacacuggucgaguccucuucgaagcuaaacugcacaaguuaggguuuaugaccauugccaaaaacggcgauagccccaucacagugccaccuaauggauacuuccgcuucgagucauggguuaaccccuuuuauacccuggcaccaaugggcacugggaauggaagaaggcggauacaguga

SEQ ID NO: 20044 - RNA, 1647 nt, Artificial Sequence
  derived and/or modified sequence opt3 from VP1__Norovirus_and/or_Norovirus-like__AB190457
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugauugcgaugcuguacacaccccucagagccaauaacucuggagacgauguuuucacugugucguguagggucuuaacccggccuucaccagacuuuagcuucaauuuucuggugcccccgacaguggaaaguaagaccaaaccuuucacucuucccaucuugacaauauccgagaugucuaacagccgcuuuccagucccuauugauucccugcauaccucacccacggaaaauaucguugugcagugccagaacgguagaguaacucuagacggcgagcucauggggaccacacaacugcuuccaagucagauuugugcauucaggggagugcugacucggagcaccucucgcgcuuccgaucaggccgacacagcuacgccccgauuguucaauuauuacuggcacauccagcucgacaaccugaauggcaccccuuaugauccagccgaggacaucccgggucccuuagggacuccugauuuuagaggaaaggucuucggcguggcaucacaaaggaacccagacagcacaacccgggcccaugaagcuaaaguugauacuacagcgggccguuuuacccccaagcuggggagucucgagauuucuacggaauccggagacuucgaucagaaucagccuacccgcuuuacaccaguggguauaggcgucgacaacgaggcagauuuccaacaguggagccuucccgacuacucggggcaguuuacucacaauaugaaccuggccccggcuguggccccuaauuucccaggagaacaguugcuauuuuucagaucucaacugcccuccucaggcgguaggaguaacgggauccucgauugccugguaccucaggaguggguucagcacuuuuaccaggagagcgcacccgcccaaacccagguggcucuuguccgguaugugaacccagacacaggccgaguccuguucgaagccaaguugcauaaacucggauuuaugacuauugcaaagaauggcgacuccccuaucaccgugcccccaaacggguacuuccgcuucgagucuuggguuaauccguuuuauacacuggcgccuaugggaaccgguaacggcagaaggcggauacaguga

SEQ ID NO: 20045 - RNA, 1647 nt, Artificial Sequence
  derived and/or modified sequence opt3 from VP1__Norovirus_and/or_Norovirus-like__AF425768
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugauugcgaugcuguacacaccccucagagccaauaacucuggagacgauguuuucacugugucguguagggucuuaacccggccuucaccagacuuuagcuucaauuuucuggugcccccgacaguggaaaguaagaccaaaccuuucacucuucccaucuugacaauauccgagaugucuaacagccgcuuuccagucccuauugauucccugcauaccucacccacggaaaauaucguugugcagugccagaacgguagaguaacucuagacggcgagcucauggggaccacacaacugcuuccaagucagauuugugcauucaggggagugcugacucggagcaccucucgcgcuuccgaucaggccgacacagcuacgccccgauuguucaauuauuacuggcacauccagcucgacaaccugucaggcaccccuuaugauccagccgaggacaucccgggucccuuagggacuccugauuuuagaggaaaggucuucggcguggcaagccaaaggaauccagacaguacaacccgggcccaugaagcuaaaguugauacuacagcgggccguuuuacccccaagcuggggucucucgagauuuccacggaaagcgacgauuucgaccagaaccagccuacccgcuuuacaccagugggagucgguguggaucacgaggcagacuuccaacaguggucgcuucccgauuacucuggccaguuuacucacaauaugaaccuggccccggcuguagccccuaauuucccaggggaacaguugcuauuuuucagaucccaacugcccucaaguggaggcaggagcaacgguauacucgacugccugguuccucaggagugggugcagcauuuuuaccaggaguccgcacccgcccaaacccaggucgcucuugugcgguaugucaauccagacacagggcgagugcuguucgaagccaaguugcacaaacucggcuuuaugacuaucgcaaagaacggagauucuccuauuaccguucccccaaacggcuacuuccgcuucgagagcugggugaauccguuuuauacacuggcgccuauggggaccggaaacgguagaaggcggauccaguga

SEQ ID NO: 20046 - RNA, 1647 nt, Artificial Sequence
  derived and/or modified sequence opt3 from VP1__Norovirus_and/or_Norovirus-like__AF414415
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggccguccuggcuggcaaugccuuuacugcaggcaaagugauuuucgcugccauacccccuaacuuuccaaucgauaaucuuagugcggcccagaucacgaugugcccgcauguuauuguggacguccggcaacuggaacccaucaacuugccuaugccagaugugcgcaauaacuucuuucacuauaaccaggggagcgacucccgacuccgucugauugcaaugcuguacacaccccucagagcuaauaacucuggagaugacguauucaccguuucguguaggguguuaacucggccuucaccagauuuuagcuucaauuuucuggugcccccgaccgucgagaguaagacaaaacuuuucaccuugccuauccugacuauauccgaaaugucuaacagccgcuuucccgugccaauugacucccuacauacaucaccuaccgagaauaucgucguucagugccagaacgguagagugacgcucgauggcgagcugauggggacuacccaacuucugcccagucagauuugugccuucaggggaacauugacucggagcaccucucgcgcuuccgaccaggccgauacaccaacgccccgacucuucaaucacagauggcauauccagcuggacaacuuaaauggcaccccuuaugacccagcagaagauaucccggcuccccuggguacuccugacuuuagggggaagguauucggaguggccucacaacggaacccagauagcacaacccgugcgcacgaggcaaaagucgacacuacaagugaucgcuuuacccccaagcucggcucucuugaaauuauaacggaguccggcgacuucgauaccaaucagagcacaaaguuuacuccuguggggaucggaguugacaacgaagccgaguuccagcaauggucgcugccaaauuacucuggucaguuuacccacaacaugaauuuggcucccgccguggcaccgaacuucccuggcgagcagcuacuguuuuucagaucccagcucccaucaagugggggaaggagcaacggcguccuggauugccuugugccccaagaauggguacagcauuuuuaucaggaguccgccccugcucagacacaaguugcccuggugcgguacgucaaucccgacacuggucgaguguuguucgaagcaaaacuccacaagcugggguuuaugaccauugcgaaaaacggcgauucuccaaucacagucccucccaauggauacuuccgcuucgagagcugggugaacccauuuuauaccuuagcuccgaugggcacugggaauggaagaaggcggauacaguga

SEQ ID NO: 20047 - RNA, 1647 nt, Artificial Sequence
  derived and/or modified sequence opt3 from VP1__Norovirus_and/or_Norovirus-like__KT779557
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaacggacaaucuuagugccgcgcagaucaccaugugcccgcaugugaucgucgaugugcggcaacuggagcccauuaacuugccuaugccagacguacgcaauaacuucuuucacuauaaccaggggagcgauucccgacuccgucugaucgccaugcuguacacaccccucagagcaaauaacucuggagacgauguuuucacugugucguguagggucuuaacccggccuucaccagacuuuagcuucaauuuucuggugcccccgacaguggaaaguaagauuaaaccuuucacccuucccaucuugacuauauccgagaugucuaacagccgcuuuccagucccuauugauucccugcauacaucacccaccgacaauaucguugugcagugccagaacgguagaguaacgcuagauggcgaacucauggggacuacccaacugcuuccaagucagauuugugcuuucaggggagugcugacacggagcacuucucgcgccuccgaccaggcugacgccgcaacaccccgauuguucaauuaucacuggcauauccagcucgauaaccugaauggcaccccuuacgacccagccgaggauaucccggcucccuuagguaccccugacuuuagagggaaggucuucggaguggcgucacaaaggaacccagauagcacgacucgggcacacgaggccaaaguugacacaaccaguggccguuuuacucccaagcugggcucucucgaaauuuccacagagagcggggauuucgaccagaaucagccuauacgcuuuaccccagugggaaucggugucgauaacgaagcugacuuccaacaguggacgcuucccgauuauucgggccaguuuacccacaauacaaaccuggccccggcaguggccccuaauuucccaggggagcaguugcuauuuuucagaucucaacugcccuccucaggaggcaggaguaacgguauucucgacugccugguaccucaggaauggguucagcauuuuuaccaggagagcgcucccgcccaaacucagguggcacuuguccgguacgugaacccagacaccgggcgaguccuguucgaggcgaaguugcacaaacucggcuauaugacaaucgcuaaguccggagauucuccuauaacugugcccccaaauggcuacuuucgcuucgaaagcuggguuaacccguucuauacccuggccccuauggggacaggaaaugguagaaggcggauucaguga

SEQ ID NO: 20048 - RNA, 1647 nt, Artificial Sequence
  derived and/or modified sequence opt3 from VP1__Norovirus_and/or_Norovirus-like__AY247432
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugauugcgaugcuguacacaccccucagagccaauaacucuggagacgauguuuucacugugucguguagggucuuaacccggccuucaccagacuuuagcuucaauuuucuggugcccccgacaguggaaaguaagaccaaaccuuucacucuucccaucuugacaauauccgagaugucuaacagccgcuuuccagucccuauugauucccugcauaccucacccaaugguaacuucguugugcagugccagaauggcagaguaacgcuagacggggaacucaugggaacuacccaacugcuuccaagucagaucugugcauucaggggcgugcugacacggcaggucagccgcgcuggugaucagauugacacugccacaccccgaucuuuugggaaccacuggcauauccaauuggacaaucucaacggaaccccuuaugauccagcugaggacaucccgggcccccugggcaccccugauuuccaggggauuguguuuggaguugccucccagagaaauucagacgguacgacuagggcacacgaggccaagguggauacacggaccggccguuucacuccaaaauuagggagccuggucauaaguacagacucugaagauuuucaacagaacaagcccacccgcuucacgccugugggaguaggcguugacuccgaggaagaguuugaucaguggagccucccagacuacucgggucccaucacccacaauaugaaccuugcuccggcgguggcaccuaauuucccaggggaacagcuguuguuuuucagaucucaacuacccuccucaggcggaauuaguaagggcauccuggauugccucgucccucaggagugggugcagcauuuuuaucaggagagcgcccccgcucaaacacaggucgcccuggugagguacguuaacccagacacugggcgggugcuuuucgaagcaaaacugcacaaguugggauuuaugaccauagccaaagacggugauuccccuauuacaguacccccaaacggcuacuuccgauucgagucuugggucaauccguuuuauacucucgcuccuauggggaccggaaacggccgcagaaggauccaguga

SEQ ID NO: 20049 - RNA, 1647 nt, Artificial Sequence
  derived and/or modified sequence opt3 from VP1__Norovirus_and/or_Norovirus-like__AF414411
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggccuagagaucaauccuuaccucgcccaccuggcgaggauguauaacgguuacgcagggguguucgagguccaggugguucuugccggaaaugcuuuuacugccggcaaagugauuuucgcagcuaucccacccaacuuuccuauagauaaucugagugccgcgcagaucacgaugugcccacaugucauuguggacguacggcaauuggaaccgaucaaccuccccaugccugauguucgcaauaacuucuuucacuauaaccagggcagcgacucccgacugcgucugauugccaugcucuacaccccauuaagagcaaauaacucuggggaugacguguucacagucucguguagggugcugacucggcccucaccugauuuuagcuucaauuuucuugugccacccaccgucgagaguaagacaaaauuguucacccugccgauccuaacuauauccgaaaugucuaacagccgcuuuccuguucccauugacucccuccauacaucaccaaccaagaauaucgugguacagugccagaacggaagagugacgcuggauggugagcuuaugggcacuacccaacuguugccuagucagauuugugcuuucagggggacacucacucggagcaccucucgcgccuccgaccaggcugauacacccaccccacgacuguucggacacagauggcauauccaguuagacaaucugaacggcacgcccuaugacccugccgaggauaucccagcaccgcucgguacucccgacuuuagggggaaagucuucggaguggccucacaacggaauccugauagcacaacccgugcucacgaagcgaagguugacacuacaaguggccgcuuuaccccaaagcucggcucucuggagauuauaacggaauccgaugacuucgauaccaaccagagcacaaaauuuacucccguggggaucggagucgacaaugaggcagaguuccagcaauggucguugccuaacuacucuggucaguuuacccacaauaugaaccuagccccagcuguggcccccaauuucccgggcgaacagcugcucuuuuucagaucccagcugccuucaagugggggaaggagcaacggcguacuugauugccugguuccacaagagugggugcagcauuuuuaucaggaauccgcacccgcccagacacaagucgcuuuggugcgguacgucaacccugacacuggucgagugcuuuucgaggccaagcugcacaaauuaggguuuaugaccauugcaaagaauggcgauucucccaucacaguuccaccuaacggauacuuccgcuucgaaagcugggugaaucccuuuuauacccuggcgccaaugggcacugggaacggaagaaggcggauacaguga

SEQ ID NO: 20050 - RNA, 1647 nt, Artificial Sequence
  derived and/or modified sequence opt3 from VP1__Norovirus_and/or_Norovirus-like__AJ277617
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucgcucaggccccuggcggggaauuuacaguuucuccaagaaauucacccggagaggugcuguugaacuuagaacugggcccugagaucaauccauaccuagcgcaccucgcaaggauguauaacgguuacgccgggggauucgagguacaggugguccuggcuggcaaugccuuuacugcaggcaaagugauuuucgcugccauacccccuaacuuuccaaucgauaaucuuagugcggcccagaucacgaugugcccgcauguuauuguggacguccggcaacuggaacccaucaacuugccuaugccagaugugcgcaauaacuucuuucacuauaaccaggggagcgacucccgacuccgucugauugcaaugcuguacacaccccucagagcuaauaacucuggagaugagguauucaccguuucguguaggguguuaacucggccuucaccagacuuuagcuucaauuuucuggugcccccgaccgucgaaaguaagacaaaacuuuucaccuugccuauccugacuauauccgagaugucuaacagccgcuuucccgugccaauugauucccuacauacaucaccuaccgagaauaucgucguucagugccagaacgguagagugacgcucgacggcgaacugauggggacuacccaacuucugcccagucagauuugugccuucaggggaacauugacucggagcaccucucgcgcuuccgaucaggccgacacaccaacgccccgacucuucaaucacagauggcauauccagcuggauaacuuaaauggcaccccuuaugacccagcagaggacaucccggcuccccuggguacuccugauuuuagggggaagguauucggaguggccucacaacggaacccagacagcacaacccgugcgcacgaagcaaaagccgauacuacaaguggccgcuuuacccccaagcucggcucucuugagauuauaacggaauccgacgauuucgacaccaaucagagcacaaaguuuacuccugucgggaucggaguggauaacgaggcugaguuccagcaauggucgcugccaaauuacucuggucaguuuacccacaacaugaauuuggcccccgcaguugccccgaacuucccuggcgaacagcuacuguuuuucagaucccagcucccaucaagugggggaaggagcaacggcgugcuggacugccuuauuccccaagaguggguccagcauuuuuaucaggaauccgcuccugcccagacacaaguggcacugguacgguacguuaaucccgauacuggucgaguguuguucgaggcgaaacuccacaagcugggguuuaugaccaucgcuaaaaacggcgacucuccaauaacagucccucccaauggauacuuacgcuucgaaagcugggugaacccauucuauacccuggccccgaugggcacugggaauggaagaaggcggauucaguga

SEQ ID NO: 20051 - RNA, 1647 nt, Artificial Sequence
  derived and/or modified sequence opt3 from VP1__Norovirus_and/or_Norovirus-like__LC036561
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugauugcgaugcuguacacaccccucagagccaauaacucuggagacgauguuuucacugugucguguagggucuuaacccggccuucaccagaauuuagcuucaauuuucuggugcccccgacaguggagaguaagaccaaaccuuucacucuucccaucuugacaauauccgaaaugucuaacagccgcuuuccagucccuauugacucccugcauaccucacccacggagaauaucguugugcagugccagaacgguagaguaacucuagauggcgagcucauggggaccacacaacugcuuccaagucagauuugugcauucaggggagugcugacucggagcaccucucgcgcuuccgaccaggccgauacagcuacgccccgauuguucaauuauuacuggcacauccagcucgacaaccugaauggcaccccuuaugacccagccgaagauaucccgggucccuuagggacuccugacuuuagaggaaaggucuucggcguggcaucacaaaggaacccagauagcacaacccgggcccaugaggcuaaaguugacacuacaaguggccguuuuacccccaagcuggggucucucgaaauuuccacggagagcggagauuucgaccagaaucagccuacccgcuuuacaccaguggguauaggcgucgaucacgaagcggacuuccaacaguggucgcuucccgauuacucugggcaguuuacucacaacaugaaucuggcaccggccguggcuccuaacuucccaggagagcaguugcuauuuuucagaucccaacugcccucaaguggcgguaggagcaaugggauccucgacugccugguaccucaggaguggguucagcauuuuuaccaggaauccgcccccgcacaaacccagguggcccuuguccgguaugugaacccagauacaggccgaguccuguucgaggcuaaguugcacaaacucggauuuaugacuauugccaagaacggcgacucuccuaucaccgugcccccaaauggguacuuccgcuucgaaagcuggguuaacccguuuuauacacuggcaccuaugggaaccgguaauggcagaaggcgggugcaguga

SEQ ID NO: 20052 - RNA, 1647 nt, Artificial Sequence
  derived and/or modified sequence opt3 from VP1__Norovirus_and/or_Norovirus-like__KT732274
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugguugcgaugcuguacacaccccucagagccaauaacucuggagacgauguguucacugucucguguaggguguuaacccggccuucaccagaauuuagcuucaauuuucuggugcccccgacagucgagaguaagaccaaacuuuucacuuugccuauucugacaaucuccgaaaugucuaacagccgcuuucccguuccaauagacucccuacauaccucaccuacggagaauauugugguacagugccagaacgguagagugacucucgauggcgagcugauggggaccacacaacuucugcccagucagaucugugcauucaggggagucuugacucggagcaccucucgcgcuuccgaccaggccgauacagcuaccccacgacucuucaauuauuacuggcacauucagcuggacaacuuaaauggcacgcccuaugacccugccgaagauaucccagguccgcuggggacucccgacuuuagaggaaagguguucggcguugcaucacaaaggaacccugauagcacaacccgggcccaugaggcuaaaguggacacuacaaguggccguuuuaccccaaagcucgggucucuugaaaucuccacggagagcggagauuucgaccagaaucagcccacccgcuuuacaccugucgguauuggcguggauucggaagcggacuuccaacaguggucucugccagauuacuccgggcaguuuacucacaacaugaauuuggcacccgccguagcuccgaacuucccuggagagcagcuacuguuuuucagaucacaacucccaaguagcggcgguagguccaaugggauacuggacugccuuguuccccaggagugggugcagcacuuuuaccaggaaucugccccugcacaaacccaggucgcccuggugcgguaugucaaccccgauacaggccgaguguuguucgaggcuaagcuccauaaacugggauuuaugacuaucgccaagaacggcgacagcccaauuaccguuccucccaauggguacuuccgcuucgaaucaugggugaacccauuuuauacauuagcaccgaugggaaccgguaauggcagaaggcggguacaguga

SEQ ID NO: 20053 - RNA, 1647 nt, Artificial Sequence
  derived and/or modified sequence opt3 from VP1__Norovirus_and/or_Norovirus-like__AY247439
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgacaaucuuagugccgcgcagauuacgaugugcccgcauguuaucguggauguccggcaacuggagcccgugaacuugccuaugccagacguacgcaauaacuucuuucacuauaaccaggggagcgauucccgacuccgucugauugccaugcuguacacaccccucagagcaaauaacucuggagacgauguuuucaccgugucguguagggucuuaacucggccuucaccagacuuuagcuucaauuuucuggugcccccgaccguggaaaguaagacaaaaccuuucacccuucccaucuugacuauauccgagaugucuaacagccgcuuuccagucccuauugauucccugcauacaucacccaauaacaauuucguugugcagugccagaacgguagaguaacccuagacggcgaacucauggggacgacucaacugcuuccaagucagaucugugcuuucaggggagugcuggcccggcagauuaaucgcgcuggcgaucagaucgacaccacaacuccccgaucuuuugaccaccauuggcacauccaauuggauaaccucaaugguaccccuuaugacccagccgaggauauuccggggccccugggaacaccuggcuucaagggcauagucuuugggguggcaagccagagaaacuccgacggaaccacgagggcccacgaggcuaaaguugauacucggacaggucguuucaccccaaaguuaggcucacuggugaucagcacugacagugaagauucucagcaaaauaagcccacacgcuuuaccccugucggggugggaguagacaacgaggaagaguucgaucaguggucccucccaaauuacagcggccccauuacgcauaacaugaaccuugcgccggcaguugccccuaauuuuccaggugaacagcuguuguucuuuagaucgcagcuacccucuuccgggggcaccucaaaaggaauccuggacugccucgugccucaagaguggguccagcacuucuaucaggagagugcucccgcccagacacaaguggcacuggucagguacgugaacccagauacuggccggguucuuuuugaagccaagcugcauaaauugggguucaugaccauagcuaaggacggagacagcccuauuacagugcccccaaaugguuacuuucgauucgaguccuggguaaacccguucuauacucucgccccuaugggcaccgggaauggacgcagaaggauccaguga

SEQ ID NO: 20054 - RNA, 1647 nt, Artificial Sequence
  derived and/or modified sequence opt3 from VP1__Norovirus_and/or_Norovirus-like__AF539439
augaagauggccagcuccgacgcuacccccucuaacgauggcgcagccgggcuggugccugagaucaauaacgaagcgauggcucucgacccagucgccggagcagccauugcugcaccgcuuacaggucagcaaaauauaaucgaucccuggauuaugaacaauuucguucaggccccuggcggggaguuuacugugucaccaagaaacagucccggagaacuguuguuaaaucuggagcuaggcccugaaaucaacccauaccucgcucaccuggccaggauguauaaugguuacgcagggggauucgagguacaggugguccuugcaggcaacgccuuuacggcuggcaaaauuaucuucgccgcaauacccccuaauuuuccaaucgacaaccugagcgcugcccagauuaccaugugcccgcaugugaucguugaugugcggcaauuggagcccgucaaucucccuaugccagacgugcgcaacaauuucuuucacuauaaccagggguccgauucucgacugcgucugauugcgaugcucuacacacccuuaagagccaacaauucgggagacgauguauucacuguuucauguagggugcugacccggccuagcccagacuuuaguuucaacuuucuugugcccccgacagucgaauccaagaccaaaccuuucacuuugcccauccugacaauaucugagaugagcaauucccgcuuuccagugccuauugauucacuacauaccagucccacggaaaacaucgucguucagugccagaaugguagagugacucucgacggcgagcugauggggaccacacaacuucugccaagccagauuugugcauucaggggaguauugacucggucuaccucccgcgcuucagaucaggccgacacacccaccccucgacucuucaacuauuacuggcacauccagcuggacaauuuaaacggcacgccauaugauccggcugaggacauccccgguccucuggggacuccagauuuuagaggaaagguguucggcgucgccagccaaaggaaucccgacaguacaacccgggcacaugaagccaaaguggauacuacagcuggccguuuuaccccuaagcucgggucucuugagauuuccacggaaagcggagacuucgaucagaaccagccaacccgcuuuacacccguugguauaggcguggaccacgaggcggauuuccaacaguggucgcugccggacuacucugggcaguuuacucacaauaugaacuuggcgccugccgucgcuccaaauuuccccggagaacagcuacuguuuuucagaucccaacucccuucaaguggcgguaggagcaacgggauccuggauugccuugugccccaggaguggguacagcauuuuuaccaggaguccgccccagcacaaacccagguugcccuggugcgguaugucaauccugacacaggccgaguguuguucgaagcuaagcuccacaaacugggauuuaugacuauugccaagaacggcgacucucccaucaccgucccaccgaacggguacuuccgcuucgagagcugggugaauccuuuuuauacauuagcacccaugggaaccgguaacggcagaaggcggauacaguga

SEQ ID NO: 20055 - RNA, 1647 nt, Artificial Sequence
  derived and/or modified sequence opt3 from VP1__Norovirus_and/or_Norovirus-like__AF414413
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugguguuuucaccgugucguguagggucuuaacucggccuucaccagacuuuagcuucaauuuucuggugcccccgaccguggagaguaagacacgccuuuucaccuugccuauccugacuauauccgaaaugucuaacagcagauuucccgucccaauugauucccuacauacaucaccuaccgagaauaucguugugcagugccagaacggcaggguaacgcucgacggggagcugaugggaacuacccaacuucugcccagucagauuugugcuuuccggggcacauugacucgcagcaccucucgagccuccgaucaggcugacacaccaauccccagacucuucaaucacagguggcauauccagcuggauaacuuaaaugguaccccuuaugacccagccgaagacauuccggcaccccuggggacgccugauuuucggggaaaaguguucggcgucgccucacaacguaacccagacagcacuacacgcgcucacgaggcgaagguggaugcaacccccggcagauuuacuccuaaacucgggagucuugaaauaaucacagagucugacgauuucgacaccaaucaguccacgaaguuuaccccaguuggaauugguguggauaacgaagccgaguuccagcaauggagccugcccaauuacucgggccaguuuacacacaacaugaauuuggcuccggccgucgcaccuaacuucccaggggagcagcuacuguuuuucaggucucagcuccccuccucaggaggccggaguaacggugugcuggacugccuuguaccucaagaauggguucagcauuuuuaucaggagagcgcccccgcucagacucaaguggcccugguccgauacgugaauccagauaccgggcgcgucuuguucgaagcaaagcuccacaaacugggcuuuaugacaaucgcgaagaacggagacuccccuauaacugugcccccaaauggcuacuucagauucgagucuuggguuaacccguuuuauaccuuagcuccuauggggacaggaaaugguaggcggcgcauucaguga

SEQ ID NO: 20056 - RNA, 1647 nt, Artificial Sequence
  derived and/or modified sequence opt3 from VP1__Norovirus_and/or_Norovirus-like__AF427112
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcaggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugauugcgaugcuguacacaccccucagagccaauaacucuggagacgauguuuucacugugucguguagggucuuaacccggccuucaccagacuuuagcuucaauuuucuggugcccccgacaguggaaaguaagaccaaaccuuucacucuucccaucuugacaauauccgagaugucuaacagccgcuuuccagucccuauugauucccugcauaccagacccacggaaaauaucguugugcagugccagaacgguaggguaacucuagacggcgagcucauggggaccacacaacugcuuccaucacagauuugugcauuccggggagugcugacucgcaguaccagccgagcuucugaucaggccgacacagcuacccccagauuguucaauuauuacuggcacauccagcucgacaaccugaauggcacgccuugcgauccagccgaggacaucccgggucccuuagggacuccugauuuuaggggaaaggucuucggcguggcaucccaacggaacccagacucaacaaccggcgcccaugaagcuaaaguugauacuacagcggggcguuuuacccccaagcugggaagccucgagauuaguacggaaucuggugacuucgaucagaaucagccuaccaaguuuacaccagugggcauaggggucgaccacgaggcagauuuccaacaguggucccuucccgacuauagcggacaguuuacucacaacaugaaucuggccccggcuguggccccuaacuucccaggcgaacaguugcuauuuuuccgcucgcaacugcccucuuccggugggagaucaaauggcauccucgauugucugguaccucaggaguggguucagcauuuuuaccaggagagugcacccgcccaaacccagguggcucuugucagguacgugaacccagacacaggacggguccuguucgaagccaaauugcacaagcucggcuuuaugacuauugcgaaaaacggggacagcccuaucaccgugcccccaaauggauauuuccgauucgaguccuggguuaacccguuuuacacacuggcgccuauggguaccggcaaugggcgcagaaggauacaguga

SEQ ID NO: 20057 - RNA, 1647 nt, Artificial Sequence
  derived and/or modified sequence opt3 from VP1__Norovirus_and/or_Norovirus-like__AF190817
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaaucccccuggagaaguacuguugaacuuagagcugggcccagaaaucaaucccuaccuagcucaccucgccaggauguauaacgguuacgcagggggauucgaggugcaggucgugcuggcgggcaaugccuuuacggcuggcaaaauuaucuucgccgcaauaccuccaaacuuuccgaucgacaaucuuucagcugcccagauuaccaugugcccccauguuaucguggauguccggcaacuggagccugugaacuugccaaugcccgacguacgcaauaacuucuuucacuauaaccaggggagugauagccgacuccgucugauugcgaugcuguacacaccucucagagccaauaacuccggagacgauguuuucacugugucuuguagggucuuaacccggccaucgcccgacuuuucauucaauuuucuggugccgccuacaguggaaagcaagaccaaacccuucacucuuccaaucuugacaauaagugagauguccaacucucgcuuuccuguccccauugaaagccugcauaccgguccaacggagaauaucguugugcagugccagaacggcagaguaacucuagauggggagcucaugggaaccacacaacugcuucccucccagauuugugcauucaggggcgugcugacucggucaaccagucgcgcuagcgaccaggccgauacagcuaccccucgauuguucaauuauuacuggcacguccagcucgacaaccugaaugguacgccauaugacccggccgaagauauccccgggccuuuaggaacuccagacuuuagaggcaagguguucggcguugcaucucaaaggaaccccgauuccacaacccgggcccaugaggcuaaaguggacacuacagcggggcguuuuaccccuaagcugggaucacucgaaaucagcacggauaguucugacuucgaucagaaucagccaacccgcuuuacacccgucgguauuggcguggacaacgaggcagauuuccaacaguggucccuuccggacuacagcgggcaguuuacucacaauaugaaccuggccccugcuguagccccaaauuuccccggagaacaguugcuauuuuucagaucgcaacugccuucuuccggcgguaggucaaacgggguucucgauugccuggugccccaggagugggcacagcacuuuuaccaggagagugccccagcucaaacccaggucgcccuugugcgguaugucaacccugacacaggccgagugcuguucgaagcaaaguugcauaaacucggauuuaugacuauagcgaagaauggcgacagccccaucaccguuccaccgaacggguacuuccgcuucgaguccugggugaauccuuuuuauacacuggcucccaugggaaccgguaacggcagaaggcggauucaguga

SEQ ID NO: 20058 - RNA, 1647 nt, Artificial Sequence
  derived and/or modified sequence opt3 from VP1__Norovirus_and/or_Norovirus-like__LC035072
augaagauggccagcaacgacgcuacccccuccaaugauggcgcagccgggcuggugccugagaucaacaaugaagcgauggcucucgacccagucgccggagcagccauugcugcaccgcuuacaggucagcaaaacguuauagaucccuggaucaugaauaacuucgugcaggccccuggcggggaguuuacuguaucuccaagaaauucacccggagaagugcuguugaacuuagagcugggcccugaaauuaauccauaccuagcucaccucgccaggauguauaacgguuacgcagggggauucgagguccaggugguucuggcaggcaaugccuuuacggcuggcaaaaucauuuucgccgcaauacccccuaacuuuccaaucgacaaucuuagugcugcccagaucaccaugugcccgcaugugauugucgaugugcggcaacuggagcccguaaacuugccuaugccagacguucgcaauaacuucuuucacuauaaccaggggagcgauucccgacuccgucugaucgcgaugcuguacacaccccucagagccaauaacucuggagacgauguguucacugucucguguaggguguuaacccggccuucaccagaauuuagcuucaauuuucuggugcccccgacagucgagaguaagaccaaaccuuucacucuucccauuuugacaaucuccgaaaugucuaacagccgcuuuccaguuccuauagacucccugcauaccucacccacggagaauauugugguacagugccagaacgguagagugacucuagauggcgagcucauggggaccacacaacugcuuccaagucagaucugugcauucaggggaguccugacucggagcaccucucgcgcuuccgaccaggccgauacagcuacgccccgauuguucaauuauuacuggcacauucagcucgacaacccuaauggcaccccauaugacccggccgaagauauccccgguccucuggggacuccagacuuuagaggaaagguguucggcguugcaucacaaaggaaccccgauagcacaacccgggcccaugaggcuaaaguggacacuacaaguggccguuuuaccccuaaguuagggucucuggaaaucuccacggagagcgaugacuucgaucagaaucagccaacccgcuuuacacccgucggaauugguguggacagagaagcggauuuccaacaguggucgcucccggacuacucuggccaguuuacucacaacaugaaucuugcgccugccguagcugccaacuccccaggggagcagcugauauucuuuuggucacaaagucccuacugcggaggcaggagcaaucggguuuuggauuguauggugccucaggaguggguccagcacuucuaucaggaauccgcacccgcccaaacccagcuagcucuggugcgauacgucaacccagacacaggucgcgugcucuuugaggccaagcugcauaaacuuggguucaugacuaucgcaaagaacggcgacucuccuauuaccguucccccaaauggauauuuuagauucgaaagcugggugaacccguucuacacacuggcgccuaugggcaccgggaauggaaggcggcgcguacaguga

SEQ ID NO: 20059 - RNA, 1647 nt, Artificial Sequence
  derived and/or modified sequence opt3 from VP1__Norovirus_and/or_Norovirus-like__DQ093064
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagauaacauuucugcugcccagaucacuaugugcccgcacguuauaguggacguccgccagcuugaacccgugcuguugccucucccagauauccgaaauagauuuuuccauuauaaccaggagaauacgccccguaugaggcugguggcaaugcuguacaccccucuccgggcuaacucgggcgaagacgucuuuacaguuucaugucgcguguuaacuagaccagcccccgauuucgaguuuaccuuccugguaccgccuacaguggagagcaagaccaaacccuuuacucuuccaauuuugacacugggcgaacuaaguaacuccagguucccugcggccaucgacaugcucuaugcagaucccaaugagucuauugucgugcaaccacagaacgggcggugcacccuggacggaacgcuucaggguacuacccagcugguucccacacaaaucugugcuuuucgcggcacuuugauaagccagaccgcccgagcuacagauuccaccgacucaccucagagagccagggaucacccacuccaugugcaagucaagaaucuggacgggacgcaguacgacccgacugaugacauucccgcaguguuaggagccaucgauuucaaaggcacaguauucgguguugcuagucagcgggacgugagcgggccucaggaacaaggacacuaugcgacccgugcacacgaggcccauauugauacuacagacccaaaguacgcucccaagcugggcaccauccucaucaaaucugaauccaacgauuuuauuacgaaucagccuauacgcuucaccccagucggcaugggggacaacaauuggagacagugggagcuucccgauuacucaggaaggcugacauugaacaugaaucuagccccggcagugagcccuaguuuuccaggugagcggauccuguucuuucgaucuauuguccccuccgccggcggguauggaagcggcuacaucgacugccucauaccucaggaauggggucaacacuucuaucaggaggcugcccccucgcagucugcaguggcgcugguucgcuacgugaacccagauacugggagaaauauuuuugaagcuaaacuucauagggagggcuuccugaccguagccaacuccggaaauaacccuaucgucgugcccccaaauggcuauuuucgguucgaagcauggguuaaccaguuuuacacauuggccccgauggggucaggacaaggucgcagaagguga

SEQ ID NO: 20060 - RNA, 1647 nt, Artificial Sequence
  derived and/or modified sequence opt3 from VP1__Norovirus_and/or_Norovirus-like__L23830
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccgcaaaaguuauuuucgcugccauacccccuaacuuuccaaucgacaaucuuagugcggcccagaucacgaugugcccgcaugugauugucgaugugcggcaacuggagcccaucaacuugccuaugccagacguacgcaauaacuucuuucacuauaaccagggcagcgauucccgacuccgucugauugcaaugcuguacacaccccucagagcuaauaacucuggggacgauguuuucaccgugucguguagggucuuaacucggccuucaccagacuuuagcuucaauuuucuggugcccaguaccauggaauccaagacaaaaccguucacccuuccuaucuugacuauaucugagaugagcaacucccgcuuucccgugccaauugauucacugcauacaaguccuaccgaaagcaucgucguucagugccagaauggaagagugacgcuagacggugagcucaugggcacuacccaacugcuucccaaccagauuugugccuucagggggacacugacucggucuaccaaucgcgcuuccgaucaggccgacacagcaaccccacgauuguucaaccaccauuggcacauccagcucgacaaucugaacggaacgcccuaugauccugccgaggacaucccagcuccguuaggcacucccgauuuuagagguaagguauucgggguggcgggacaaaggaauccugacucaacaacccgggcacacgaagccaaagucgauacuacaagcggccguuuuaccccaaagcugggcagucucgagauuacgaccgaaucugacgauuucgaccccaaccaguccacaaaguuuacuccuguggggauaggaguugauaaugaggcugacuuccagcaauggagccuuccagauuacucgggucaguuuacccauaacaugaaucuggcccccgcaguggccccgaacuucccuggcgaacaguugcuauuuuuccgcucucagcugccauccucagggggaagaaguaacggcauccucgacugccuggucccccaagagugggugcagcacuuuuaucaggagagcgcuccugcccagacacaaguagcacuuguuagguacgugaaucccgacacuggucggguccuguucgaagcgaaauugcauaagcucggguuuaugaccauugcuaaaaacggcgauuccccaaucacagugccucccaauggauacuuccgauucgagucuugggucaacccauuuuauacccuggccccgaugggcacugggaauggacgcagaaggauacaguga

SEQ ID NO: 20061 - RNA, 1647 nt, Artificial Sequence
  derived and/or modified sequence opt3 from VP1__Norovirus_and/or_Norovirus-like__KX907728
augaagauggccagcaacgacgcucccccuuccucugauggcgcagggaaucuggugccagagucacaccaggaaguccucccgcuugcccccguugcgggagcugagcuggccgcaccugugguaggucaaaccaacaucauugacccauggauaaaagaaaauuucgugcaggcuccccagggcgaguuuacagucaguccuaagaacgccccaggggaaaucuuggugaauuuagagcugggacccaaccuaaauccuuaccucgagcaucugagcagaauguauaacgcauacgccggcgguauugaaguugagaucauucuugcugggaaugccuucacugcgggaaaaauccugauagcagccgugccaccgaacuuucccgucgaauccgugucugcuucgcaggccacgcaauucccucacgcaaucguagauguuaggaccuuggagccagugcggcucccccugccugacguccgcucaaacuuuuuccauuauacaacuaaggaugagccaaaaaugcgacuggugauuuggcucuacacccccuuacguacaaauggcagcggcgacgauaguuuuaccguguccgggagacugcuuacuaggccgucuauggacuuccaguuuagcuucuuggucccucccacaguugaaaccaagacggugcuguuuacuguaccaggacuaaccccucaggagauguccaauucacgguggcccgcucagaucagugguauggugguccgcggcaacgaaccacaagugguucaguuccagaaugggagaugccacacagauggaacucuccugggcaccacaaccgugagcgagcaguguauugccgguuuugucgggacgucuacuaacacaagguccgcgaccggaucaacuacagaaacccggacgggcgacaccgaucuuuggcugcgcuuggaggagcccaacggccaaccuuaugacaucuucggggaucagccagccccgcucggaacacccgacuuccgagcagugauaguagguuuugcuagcagaccucagacucaaggcaguuacaugaaugaagccuauguuaacaccguggacucucauuucgcuccagccacagggaauacuaagauuauccugaggcggggaggcaccggucacgucgggggcggacacuuauggaaauuucgucccuucggcguggaagggggagagggucgcgucuccuaccaggaguacgugcugccuaacuauagcggcgcaacagccucgaaucauaaccucgcuccacccguugcgccgagaaugccuggggaacuucuguugcuauuugagucugauaugccagugugggacgauggacacggcgcagcccccgcucagaagauucauugccugcucccucagcaauucaucacccacuuuuucgacucccaggcccccgcacuggccgaggcugcccuucugagguacguacacccagauucaagucgggucuuguuugaaacuaaacucuaucgagaggguuucauggugguuagcgcaccuacggggcgcuuugacuucccccuggauggcuacuuuagauucgacuccugggucaauucuuucuauguguuaagcccagugggaucaggccaggggaggcgguga

SEQ ID NO: 20062 - RNA, 1644 nt, Artificial Sequence
  derived and/or modified sequence opt3 from VP1__Norovirus_and/or_Norovirus-like__AB039779
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaagauacgccccguaugaggcugguggcaaugcuguacaccccucuccgggcuaauucgggcgaggacgucuuuacaguuucaugucgcguguuaacuagaccagcccccgauuucgaguuuaccuuccugguaccgccuacaguggaaagcaagaccaaacccuuuacucuuccaauuuugacacugggcgagcuaaguaacuccagguucccugcgcccaucgacaugcucuauaccgauccaaacgaaacgauugucgugcaaccccagaaugggcggugcacucuggacggaacccuucaggguacaacucagcugguuccuacccaaaucuguucuuuucgcggcacauugauaagccagaccccacgauccgccgauucaacggacagugcaccgagagugaggaaccacccccuccauguccagcugaagaauuuagaugggacuccuuacgacccaacagacgaggugcccgcuguacugggagccauugauuucaaaggcaccguuuucgguguggcuagccaacggaacacuacagggucuuccgucggagccacccgugcacacgaagugcacaucgacacgaccaauccucgcuauacaccaaagcucggcucaguccuuauguacagcgagaguucugauuuugacgauggccagcccacuagauucaccccgauugggaugggagccgacgauuggcaucagugggagcugccugaauacuccggucacuugacacuaaacaugaaucuggcuccagcgguggcacccgccuuuccuggcgagaggauccucuucuuucggagcguugugcccucggcugggggauauggcucuggucagaucgacugccugauuccacaagaauggguacagcauuucuaccaggaggccgcaccuucccagucagccgucgcucuuauacgauaugugaaccccgauacugggcgcaauaucuuugaagccaagcugcacagagagggcuucauuaccguugcaaacaguggaaauaacccaaucguggucccgccuaauggcuacuuuagguucgaggcgugggugaaccaauuuuaugcuuugacacccauggggaccggacagggucggcgcagaguacaguga

SEQ ID NO: 20063 - RNA, 1644 nt, Artificial Sequence
  derived and/or modified sequence opt3 from VP1__Norovirus_and/or_Norovirus-like__AB039778
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaagauacgccccguaugaggcugguggcaaugcuguacaccccucuccgggcuaauucgggcgaggacgucuuuacaguuucaugucgcguguuaacuagaccagcccccgauuucgaguuuaccuuccugguaccgccuacaguggaaagcaagaccaaacccuuuacucuuccaauuuugacacugggcgagcuaaguaacuccagguucccugcgcccaucgacaugcucuauaccgauccaaacgaaacgauugucgugcaaccccagaaugggcggugcacucuggacggaacccuucaggguacaacucagcugguuccuacccaaaucuguucuuuucgcggcacauugauaagccagaccucccgaucagccgauaguacggacagcgcaccaagagugaggaaccacccgcuccauguccagcugaagaauuuagaugggacucccuacgacccuacagacgaggugccagcuguacugggagccauugauuucaaaggcaccguuuucgguguggcuucucaacggaacacuacaggguccucagucggagccacccgugcacacgaagugcacaucgacacgaccaauccccgcuauacaccuaagcucggcagcguccuuauguacagugagucuuccgauuuugacgauggccagccaacuagauucacccccauugggaugggagccgacgauuggcaucagugggagcugccggaauacagcggucacuugacacuaaacaugaaucuggcuccugcgguggcaccagccuuucccggcgagaggauccucuucuuucggucgguugugccuucugcugggggauauggcuccggucagaucgacugccugauuccccaagaauggguacagcauuucuaccaggaggccgcaccaucacagagugccgucgcucuuauacgauaugugaacccugauacugggcgcaauaucuuugaagccaagcugcacagagagggcuucauuaccguugcaaacagcggaaauaaccccaucguggucccaccgaauggcuacuuuagguucgaggcgugggugaaccaauuuuauacauugaccccuauggggacuggacagggucggcgcagaguacaguga

SEQ ID NO: 20064 - RNA, 1644 nt, Artificial Sequence
  derived and/or modified sequence opt3 from VP1__Norovirus_and/or_Norovirus-like__KY424345
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcgcccaucgauaugcucuauaccgacccaaaugaagggauugucgugcaaccccagaacggacggugcacgcuggaugguacucuucagggcaccacacagcugguuccuacucaaaucugugccuuucgcgggaccuugauaggacagacaucucgaagcuccgacucaaccgauagugcaccaagaaggcgggaccacccgcuccaugugcagcugaagaauuuagauggcacgcaauacgaccccacugacgaggucccugcugugcugggugccauugauuucaaaggggcuguauucggaguugccagccagcgugacgugucuggcacacaggucggcgcaacccgcgcccacgaagugcacaucaacacuacagauccaagauauacccccaagcucggguccauucuuaugcauucagagagcgacgauuuugucacgggacagccuauccaauucaccccaguggguaugggcgacaaugauuggcaccagugggagcugcccgacuacagugggcauuugacacuaaacaugaaucuggcuccggcgguugcacccgccuuuccaggagaaaggauccucuucuuucggucuauugugcccuccgcuggcgguuacgggagcggccagauagauugccugaucccucaggaguggguacaacacuucuaucaggaagccgcacccucgcagucugccgucgcucuuauucgauacgugaacccagacacuggacgcaauaucuuugaggccaagcugcacagagaaggcuucauaaccguugcaaacuccgggaauaacccuauuguggucccuccaaauggauauuuuagguucgaggcgugggugaaccaguuuuacacauugacuccgauggguaccggccaagggcggcgcagaaaucaguga

SEQ ID NO: 20065 - RNA, 1644 nt, Artificial Sequence
  derived and/or modified sequence opt3 from VP1__Norovirus_and/or_Norovirus-like__HQ169542
augaugauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaagauacgccccguaugaggcugguggcaaugcuguacaccccucuccgggcuaauucgggcgaggacgucuuuacaguuucaugucgcguguuaacuagaccagcccccgauuucgaguuuaccuuccugguaccgccuacaguggaaagcaaaaccaagcccuuuacucuuccaauuuugacacugggcgagcuaaguaacuccagguucccugcgcccaucgacaugcucuauaccgauccaaacgaaacgauugucgugcaaccccagaaugggcggugcacucuggacggaacccuucaggguacaacucagcugguuccuacccaaaucuguucuuuucgcggcacauuggugagccagaccucccgaucagccgauaguacggacagcgcaccaagagucaggaaccacccgcuccaugugcagcugaaaaauuuagaugggacucccuacgacccuacagacgagguaccagcuguucugggagccauagauuucaagggcaccguguucggugucgcuucucaacggaacacuacagggggauccgugggcgccacccgugcacacgaaguccacauugacacgaccaauccccgcuauacaccuaaacucggcucagugcuuauguacagcgagaguucugauuuugacgaugggcagccaacuagauucacccccaucggaaugggugccgacgauuggaggcagugggagcugccggaauacuccggccauuugacacuaaacaugaaucuggcuccugcgguugcaccagccuuucccggggagcggauucucuucuuucgaagcgugguaccuucggcuggaggcuaugguucugggcagaucgacugccugaucccccaagaauggguccagcacuucuaccaggaggccgcaccaucccagucagccguggcucuuauucgcuauguuaacccugauacuggcagaaauauauuugaagccaagcugcauagggagggauucaucaccguggcaaacaguggcaauaaccccauugucgugccaccgaauggguacuuucgguucgaggcguggguaaaccaauuuuauacauugaccccuaugggaacuggucagggccgcagaagggugcaguga

SEQ ID NO: 20066 - RNA, 1644 nt, Artificial Sequence
  derived and/or modified sequence opt3 from VP1__Norovirus_and/or_Norovirus-like__KX228762
augaagauggccagcaacgacgcugcacccuccaaugauggcgccgcgaaccuggugccugaggcuaccaaugaagucauggcccucgagccaguugugggggcaucuaucgccgcuccgguagugggacagcaaaacauuauagaccccuggaucagagaaaauuucguccaggcaccucagggugaguuuacagugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacugcgggaaaaauuaucuuugcagccgugcccccucauuucccaguagaaaauauuucugcugcccagaucacgaugugcccgcacguuauaguggauguccgccagcuugagcccgugcuguugccucucccagacauccgaaaccguuucuuucauuauaaucaggaaaacacccccagaaugaggcugguggcaaugcuguacacaccucuccgggcuaauucgggcgaggaugucuuuacuguuucaugucgcguguuaaccagaccagcccccgacuucgaguuuacauuccugguaccgccuaccguggaaagcaagacuaaacccuuuacacuuccaauuuugacccugggcgagcuaaguaacuccagguucccugcgcccaucgauaugcucuauacggacccaaacgaagccauugucgugcaaccccagaaugggcggugcacucuggauggaacccuucaggguacaacucagcugguuccuacccaaaucuguucuuuucgcggcacauugauaagccagaccucccgaucagcagacaguacggauagcgcuccaagagugaggaaccacccgcuccauguccagcugaagaauuuagacgggacucccuacgauccuacagacgaggugccagccguacugggagcuauugacuucaaaggcaccguuuucgguguggccucucaacggaacacuacaggaaauuccaucggggcaacccgugcccacgaaguccacauugauacgaccaacccccgcuauacaccuaagcucggcucagugcuuaugcauagcgagaguaaugacuuugaugacggccagccaacuagauucacccccaucgggaugggagcugaugacuggcaccagugggagcugccggaauacucuggucauuugacacuaaacaugaaucuggcgccugcagucgccccagcuuuucccggcgagaggauccucuucuuucgguccgugguuccuagcgccgggggauacggcucgggucacauugauugccugauaccccaggaaugggugcaacacuucuaucaggaggcagccccaucucaguccgcuguagcccuuauccgauacgucaacccugacacugggcgcaauauuuuugaagcaaagcugcauagagagggcuucaucaccguggcgaacucaggaaauaaccccauaguugugccaccgaauggcuauuuuagguucgaggcuugggucaaccaguuuuacacauugaccccuauggggacuggacaaggucggcgcagagugcaguga

SEQ ID NO: 20067 - RNA, 1644 nt, Artificial Sequence
  derived and/or modified sequence opt3 from VP1__Norovirus_and/or_Norovirus-like__AF414410
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaauucuucugaacuuggaguuagggccugagcugaauccauaccuaagccaccucucccggauguauaacggauacgccggcgguaugcagguucaagugguccuggcugggaaugccuucacagcgggaaagaucauuuuugcagccgugcccccucauuucccaguagaaaacaucucugcugcccagauaacuaugugcccgcacguuaucguggauguccgccagcuugagcccguguuucugccuuugccagacauucgaaaucguuucuuucauuauaaccaggaaaauacgcccagaaugaggcucguggcaaugcuguacaccccucugcgggcuaacucgggcgaggaugucuucacaguuucaugucgcgugcucacuagaccagcccccgacuuugaguucaccuuuuuaguaccgccuacaguggaaagcaagaccaaacccuucacucugccaauccuuacauugggcgagcugaguaacuccagguuuccugcgcccauugauaugcuauauaccgacccaaaugaaacgaucgucgugcaaccccagaacgggcggugcacucucgauggaacccugcaggguacaacucagcuuguuccuacccaaauauguucuuuccgcggcacacugauuagccagaccucccgaucagccgacaguacggauagcgcaccaagagcuaggaaucacccguugcaugugcagcucaagaaccuggacgggacucccuacgauccuacagacgaggucccagccguguuaggagcuaucgacuucaaaggcaccguauuugguguugccucucaacggaauacuacaggguccucagugggagcaacccgugcccacgaaguccacauugauacgaccgacccccgcuauacaccuaagcugggcagcgugcucauguacagugagucuaacgauuucgacgauggccagccaacuagauuuacccccaucgggaugggagcugacgauuggcaucagugggagcuuccggaauacuccggucaccugacauugaauaugaaccuagcgccugcagucgccccagcuuuccccggcgagaggauccuguuuuuccggagcgugguuccuucggccgggggauauggcucuggucagauugacugccucauaccccaagaaugggugcagcauuuuuaccaggaggcagccccaucccagucagcuguagcccugauccgauaugucaauccugauacugggcgcaacauuuucgaagcaaaacuucacagagagggcuuuaucaccguggcgaauaguggaaacaaucccauaguugugccaccgaacggcuacuucagguuugaggcuugggucaaucaauucuauacacugaccccuauggggacuggacagggucggcgcagagugcaguga

SEQ ID NO: 20068 - RNA, 1644 nt, Artificial Sequence
  derived and/or modified sequence opt3 from VP1__Norovirus_and/or_Norovirus-like__KU935739
augaagauggccagcaacgacgcugcacccuccaaugauggcgccgcgaaccuggugccugaggcuaccaaugaagucauggcccucgagccaguugugggggcaucuaucgccgcuccgguagugggacagcaaaacauuauagaccccuggaucagagaaaauuucguccaggcaccucagggugaguuuacagugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacugcgggaaaaauuaucuuugcagccgugcccccucauuucccaguagaaaauauuucugcugcccagaucacgaugugcccgcacguuauaguggauguccgccagcuugagcccgugcuguugccucucccagacauccgaaaccguuucuuucauuauaaucaggaaaacacccccagaaugaggcugguggcaaugcuguacacaccucuccgggcuaauucgggcgaggaugucuuuacuguuucaugucgcguguuaaccagaccagcccccgacuucgaguuuacauuccugguaccgccuaccguggaaagcaagacuaaacccuuuacacuuccaauuuugacccugggcgagcuaaguaacuccagguucccugcgcccaucgauaugcucuauacggacccaaacgaagccauugucgugcaaccccagaaugggcggugcacucuggauggaacccuucaggguacaacucagcugguuccuacccaaaucuguucuuuucgcggcacauugauaagccagaccucccgaucagcagacaguacggauagcgcuccaagagccaggaaccacccgcuccaugugcagcugaagaauuuagacgggacucccuacgauccuacagacgaggucccagcugugcugggagccauugacuucaaaggcaccguauucgguguugcaucucaacggaacacuacaggaaauuccaucggggccacccgugcucacgaagugcacauugauacgaccaacccccgcuauacaccuaagcucggcucaguccuuauguacagcgagaguaaugacuuugaugacggccagccaacuagauucacccccaucgggaugggagcggaugacuggcaucagugggagcugccggaauacucuggucacuugacacuaaacaugaaucuggccccugcaguggcuccagccuuucccggcgagaggauccucuucuuucgguccgucgugccuagcgcagggggauauggcucgggucauauugauugccugauaccccaggaauggguucaacacuucuaccaggaggccgcuccaucucaguccgccguggcacuuauccgauauguaaacccugacacugggcgcaauauuuuugaagcgaagcugcacagagagggcuucaucaccgucgcuaacucaggaaauaaccccauagugguuccaccgaauggcuacuuuagguucgaggccugggugaaccaguuuuauacauugaccccuauggggacuggacaaggucggcgcagaguccaguga

SEQ ID NO: 20069 - RNA, 1644 nt, Artificial Sequence
  derived and/or modified sequence opt3 from VP1__Norovirus_and/or_Norovirus-like__KX268709
augaagauggccagcaacgacgcugcacccuccaaugauggcgccgcgaaccuggugccugaggcuaccaaugaagucauggcccucgagccaguugugggggcaucuaucgccgcuccgguagugggacagcaaaacauuauagaccccuggaucagagaaaauuucguccaggcaccucagggugaguuuacagugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacugcgggaaaaauuaucuuugcagccgugcccccucauuucccaguagaaaauauuucugcugcccagaucacgaugugcccgcacguuauaguggauguccgccagcuugagcccgugcuguugccucucccagacauccgaaaccguuucuuucauuauaaucaggaaaacacccccagaaugaggcugguggcaaugcuguacacaccucuccgggcuaauucgggcgaggaugucuuuacuguuucaugucgcguguuaaccagaccagcccccgacuucgaguuuacauuccugguaccgccuaccguggaaagcaagacuaaacccuuuacacuuccaauuuugacccugggcgagcuaaguaacuccagguucccugcgcccaucgauaugcucuauacggacccaaacgaagccauugucgugcaaccccagaaugggcggugcacucuggauggaacccuucaggguacaacucagcugguuccuacccaaaucuguucuuuucgcggcacauugauaagccagaccucccgaucagcagacaguacggauagcgcuccaagagccaggaaccacccgcuccaugugcagcugaagaauuuagacgggacucccuacgauccuacagacgaggucccagcugugcugggagccauugacuucaaaggcaccguauucgguguugcaucucaacggaacacuacaggaaauuccaucggggccacccgugcucacgaagugcacauugauacgaccaacccccgcuauacaccuaagcucggcucaguccuuaugcauagcgagaguacugacuuugaugacggccagccaaccagauucacacccaucgggaugggagcggaugacuggcaccagugggagcugccggaauacucuggucauuugacucuaaauaugaaccuggccccugcaguggcuccagccuuucccggcgagaggauccucuucuuucgguccgucgugccuagcgcagggggauacggcucgggucacauugauugccugauaccccaggaauggguucaacacuucuaucaggaggccgcuccaucucaguccgccguggcacuuauccgauacguaaauccugacaccgggcgcaacauuuuugaagcgaagcugcauagagagggcuucaucacagucgcuaauucaggaaacaaucccauagugguuccaccgaacggcuauuuuagguucgaggccugggugaaucaguuuuacaccuugacuccuauggggacgggacaaggucggcgcagaguccaguga

SEQ ID NO: 20070 - RNA, 1644 nt, Artificial Sequence
  derived and/or modified sequence opt3 from VP1__Norovirus_and/or_Norovirus-like__KX158282
augaagauggccagcaacgacgcugcacccuccaaugauggcgccgcgaaccuggugccugaggcuaccaaugaagucauggcccucgagccaguugugggggcaucuaucgccgcuccgguagugggacagcaaaacauuauagaccccuggaucagagaaaauuucguccaggcaccucagggugaguuuacagugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacugcgggaaagauuaucuuugcagccgugcccccucauuucccaguagaaaauauuucugcugcccagaucacgaugugcccgcacguuauaguggauguccgccagcuugagcccgugcuguugccucucccagacauccgaaaccguuucuuucauuauaaucaggaaaacacccccagaaugaggcugguggcaaugcuguacacaccucuccgggcuaauucgggcgaggaugucuuuacuguuucaugucgcguguuaaccagaccagcccccgacuucgaguuuacauuccugguaccgccuaccguggaaagcaagacuaaacccuuuacacuuccaauuuugacccugggcgagcuaaguaacuccagguucccugcgcccaucgauaugcucuauacggacccaaacgaagccauugucgugcaaccccagaaugggcggugcacucuggauggaacccuucaggguacaacucagcugguuccuacccaaaucuguucuuuucgcggcacauugauaagccagaccucccgaucagcagacaguacggauagcgcuccaagagugaggaaccacccgcuccauguccagcugaagaauuuagacgggacucccuacgauccuacagacgaggugccagccguacugggagcuauugacuucaaaggcaccguucucgguguggccucucaacggaacacuacaggguccucaaucggagcaacccgugcccacgaaguccacauugauacgaccaauccccgcuauacaccuaaacuuggcagcgugcugaugcauagugagucuacugacuucgaugacggccagccaaccagauuuacacccaucgggaugggagcugaugacuggcaccagugggaguugccggaauacuccggucaucuaacucugaacaugaaucucgcgccugcagucgccccagcuuuccccggcgagaggauccuguuuuuccggagcgugguuccuucggccgggggauacggcucuggucacauugauugccuuauaccccaggaaugggugcaacacuuuuaucaggaggcagccccaucccagucagcuguagcccugauccgauacgucaacccugacaccgggcgcaauauuuucgaagcaaaguugcauagagagggcuuuaucacaguggcgaacaguggaaauaaccccauaguugugccaccgaauggcuauuucagguuugaggcuugggucaaccaguucuacacccucacuccuauggggauuggacaaggucggcgcagagugcaguga

SEQ ID NO: 20071 - RNA, 1644 nt, Artificial Sequence
  derived and/or modified sequence opt3 from VP1__Norovirus_and/or_Norovirus-like__AB126320
augaagauggccagcuccgacgcugcacccucuaccgauggcucagccagacuggugccugaggucaacaaugaaacaauggcgcucgagccaguugugggggcuccgcuugccgcacccguagccggacagcacaacaucauugacccuuggauaaaaaugaauuucgugcaagcuccaaacggugaauuuacugucagucccaggaaugcaccuggcgagauccuguuggauuuagaacuggggccagaccuaaaccccuaccucagccaucuggcccggauguauaauggauacgcuggcgguauggaggugcagguugugcuugccgggaacgcguucacggcaggaaagauuaucuuugccgcugucccuccaaauuucccggccgagaaccuguccgcagcucaggugaccaugugcccccacguaauuguugaugugcgccaguuggaaccugucaugcucccaaugcccgacauccgaaauaaacuguuucauuauaaccaaguggaugacccuaagcugcgucucuuagccuaccuguauacaccacuuagagcgaauaacgccggcgaugacguguucacugucucuuguaggguuuugacccggcccacaccggauuuugaguucauguuucuggugccucccaccguagaaucgaaaacuaagccauucucacuaccuagccucacacuggacgagcuuaguaauucccgcuuucccgcaccaauagugcagcuguacaccaacccccacgauaacuuggucgugcagccucagaauggcagaugcacgaucgacgggcuccugcaaggaacuacccaguuaguuucuuguaacgugugcagcuucagggguacaauuggcgacgggcagccagcuucccauucagaggaagagaucaugccgauggccuuuaauauucagcgggaaaucaugcuggagaaccucgauggaacucccuaugacccugcugaugacauaccagccguccuuggcagucccgauuuccaaggugugauuuucgggauccugagccagcgcaauaccgacggacagacacgagcacacgaagccaagguagauaccagagcugcgagguuugcaccuaaauugggcuucguuguggccacggucgagucuacugacuuucacgcuaaccaaccaucccgguucacacccgugggccuagggggagauaauaaccaggacuuuaaucaguggcgucugccggccuacgguggcgcacucaccaacaauacuaaccuggccccuccagucaugcccguguacccuggggagcagcuucuguucuuucgcucacaauugcccagcaguggaggcguuguggguggguggcucgauugucuguuaccacaggaauggguacagcauuucuuucaggagucugcuacaucccaaagcgacgucgcccuggugagauauauuaauccuaccacgggcaggguucuauucgaagcaaagcuccacaaacagggauuucugaccguggcggcuucgggcucuuacccccuugucgugccagccgacggguauuuccgguuugaguccuggguaaaccaguucuacacauuggcaccgaugggaaaugguucaggccgacgcagagccagguga

SEQ ID NO: 20072 - RNA, 1644 nt, Artificial Sequence
  derived and/or modified sequence opt3 from VP1__Norovirus_and/or_Norovirus-like__AY077644
augaagauggccagcaacgacgcuucccccucugcagauggcucagccgggcuggugccugaggucaauaacgaaaccauggcgcucgagccaguugugggagcuccgcuugccgcacccguagccggucagcacaauaucauugacccuuggauaaaaaugaacuucgugcaagcuccaaauggcgaauuuacagucagucccagaaacgcaccuggggagauccuguuggauuuagaacugggaccagaccuaaaucccuaccucagccaucuggccaggauguauaacggcuacgcuggugggauggaggugcagguugugcuugccggaaaugcguucacugcaggcaagauuaucuuugccgcugucccuccaaacuucccggccgagaaucuguccgcagcucaggugacgaugugcccccacguaauuguugaugugcggcaguuggaaccugucaugcucccaaugcccgacauccgcaacaaacuguuucauuauaaucaaguggaugacccuaagcugcgacucuuagccuaccuguauaccccacuucgugcgaacaaugccggcgaugacguguucacagucucuuguagaguuuugacuaggcccaccccggauuuugaguucauguuucuggugccucccacaguagaaucgaaaaccaagccauucucacuaccuagccucacucuggacgagcuuaguaacucccgguuucccgcaccaauagugcagcuguacacaaacccccacgauaauuuggucgugcagccucagaacgggcgcugcaccaucgacggacuccugcaagguacgacucaguuaguuucuuguaaugugugcagcuucagaggcacccugggggacggacagccagcuucccauucagaggaagagauuaugccgauggccuuuaacauccagagggaaauuaugcucgagaaucuugauggcagucccuaugacccuacagaugacaucccagcuguccuggguagccccgauuuccaaggggugguauucggaauauugucucagcggaacacugacggccagacccgcgcccacgaagcaaagguugauacacgacuagccagauuugcuccuaaacugggcuucguggucgcgaccguggagaauacggacuuucacgcaaaccaaccauguagguucacucccgucgggcucggaggugauaauaaccgggacuuuaaucaguggggccugccggccuacgggggagcucuuacaaacaauaccaaccuggccccuccagugaugcccguuuacccuggcgagcagcuucucuucuuucguucccagcugcccucaagcgguggggugguaggcggaugguuagauugccugcuaccacaagaauggguccagcauuucuuucaggagagugcaacuucucaguccgacguggcccucguucgcuauauuaauccuacaaccggcagagugcuguucgaagcuaaguugcacaaacaaggguuuuugacggucgccgcaagcggaucguacccccuggugguaccagcggacgguuauuucagguuugagucuugggugaaccaguucuacacccucgcuccgaugggcaacggguccggacggcgacgcguuagauga

SEQ ID NO: 20073 - RNA, 1644 nt, Artificial Sequence
  derived and/or modified sequence opt3 from VP1__Norovirus_and/or_Norovirus-like__AY823306
augaagauggccagcuccgacgcugcacccucuucagauggcagugccgggcuggugccugaggucaacagcgaaaccauggcgcucgagccaguugugggagcuccgcuugccgcacccguagccggucagcacaauaucauugacccuuggauaaaacugaacuucgugcaagcuccaaauggcgaauuuacagucucccccagaaacgcaccuggggagaucuuguuagaucuggaacuaggaccagaccucaaucccuaccuggcccaucuuucuaggauguauaacgcuuacgccggcgguauggaggugcagguuauucuggcggggaaugcauucacugccggaaagaucauuuuugcugccgugccuccaaacuucccguuggagaaucucucggcagcucagaucacgaugugcccccacauaaucgucgaugugcggcagcuggaaccuguaaugcugccaaugcccgacguucgcaaccgacucuuucauuauaaucaagugcgugagccuagauuaaggcuggucgccuaccuuuauaccccauugcgggcgaacaaugccggcgaugacguguucacagugucaugucgcguccugacuagacccagccaggauuuugaguucauguuucuaguuccgccuaguguggaauccaaaaccaagcccuucucucucccaaaccugacacuugcagagcugagcaauuccagguuuccuuugcccauugaacagcucuacaccaacccacuggacaacuuaguagugcagccccaaaauggccggugcacuaucgaugggauucugcucggaacaacccagcuugucccuucacugaucuguaguaugcgcgguacguuggaggcugaccaggccagcggccacacugaugacgaaucugugcagucccgagcuuucaacagacaaaggucacuaaugcuggagaauccagacgggagcgccuuugauccgagugacgaaguucccgcagugcucggagucccugauuuccggggcgugguauucgguguucugucucagcguaacaauggggacaccacacgcucccaugaggccaaaauagauacuagaaggccacgguaugcucccaaguugggauuuguggagguccugaccgaaagcgacgauuuccagaacggcccuccaacaaaguuuacccccgugggccuugggggagacgguaauccggauuuccaacagugggcgcucccugacuacggcggggcacugacgaacaauacuaacuuagccccacccgucgugccuguuuaccccggagagcagauucuguuuuuccgaucgcagcuaccaucuuccggcgguacaguggcuggguggcucgauugccugcuuccucaagaauggauccagcacuuuuaucaggacucagccgcagcccagagugacguagcuuugguccgcuacauuaaucccgccaccggcagagugcuguucgaggcaaaacuccacaggcaaggauuucugacuguuagcgcggcuggcccacauccgguggucgccccugcagauggguauuuccgguuugaauccugggugaaccaguucuacacacuugcccccaugggaaaugguucuggccgcagaaggguauga

SEQ ID NO: 20074 - RNA, 1638 nt, Artificial Sequence
  derived and/or modified sequence opt3 from VP1__Norovirus_and/or_Norovirus-like__KF586508
augaugauggccagcaaggacgcuaccuccaacauggauggcacaucuggggcaggacagcuggugcccgagaauaacaauacuucagaaccuaucaacauggagccagucgccggugcgguuacggcugccgcaaccgccggccaagugaauaugauugacccguggauaaugaacaauuacguacaggcuccccagggggaguucacaaucaguccuaacaauacuccaggagauauucucuuugaccuucagcugggcccccacuugaacccuuucuuagcacaucugagccaaauguauaaugguuggguggggaacaugaaagucagagugguucuagccggaaaugcuuuuuccgccggcaagaucauugugugcuguaucccacccggcuucucugcgccuaacauaucgaucgcacaggccaccauguuuccacacgucauugcugaugugaggguacucgaaccgaucgacauuccccuggaugacguucggaaugugcuuuuccauaacaacgauaaugggaaccagacaaugcgccuguugugcaugcucuacaccccucugcgaucaggagguacuagcaguggcacagacccauuugucaucgccgggcgugugcugaccugucccacgccugauuucaauuuucucuucuuagugccacccacugucgaacagaaaaccaagcaauuuuccguuccgaaccugccucuuaaugugaugucuaacagcagaguacccuccuugcugaaugcaaugguggucucaccagaccaggcucaggugguucaguuccaaaacggaaggugcacacuagauggccagaugcucgguacuaccacagugagugccagcugugucgcgcgguuucgcgggaaaaccuuccaggccccugacaauagacugggaauaaaccuugcagagauuucuggcgagcccuaucacgcuuucgaauccccagcuccccugggcuuuccugacuucggggauggagacuggcaugugacggccacuaagguaacaccaucacaauuggaggccaaugauccgguugugauggguaacguccagcccuacaauccucaguuugcaccacaccucggcacccugguggucgaaaaccccacuccugacaaugugacaaccgggacggauuuacuguucaacaucaccuggcucagcaacagggccaauaaccgguuuaauccauggguuauucccaacuauggaaguacacuuacugaggcugcgcagcuggcaccgucuaucuucccuccaggcuuuggugagaccaucguguacuucaauuccacauuucccgccguaggggcuacuacccacgccgcaauuccuugcuugcuaccccaagaguucgucgcccauuuugugaacgaacaggcuccaauacgcggcgaagccgcacugcuccacuauaucgacccugauacacaucgaaaucugggagaguucaagauuuaccccgaaggcuuuguuaccugugugccaaacgucgggggaacugguccgcagagccuuccuacgaauggcaucuucguguucguaucgugggugucuagauacuaucagcugaaacccguugggacagcgggacaagcuaggcgguuguga

SEQ ID NO: 20075 - RNA, 1638 nt, Artificial Sequence
  derived and/or modified sequence opt3 from VP1__Norovirus_and/or_Norovirus-like__HQ637267
augaugauggccagcaaggacgcuaccuccaacauggauggcacaucuggggcaggacagcuggugcccgagaauaacaauacuucagaaccuaucaacauggagccagucgccggugcgguuacggcugccgcaaccgccggccaagugaauaugauugacccguggauaaugaacaauuacguacaggcuccccagggggaguucacaaucaguccuaacaauacuccaggagauauucucuuugaccuucagcugggcccccacuugaacccuuucuuagcacaucugagccaaauguauaaugguuggguggggaacaugaaagucagagugguucuagccggaaaugcuuuuuccgccggcaagaucauugugugcuguaucccacccggcuucucugcgccuaacauaucgaucgcacaggccaccauguuuccacacgucauugcugaugugaggguacucgaaccgaucgacauuccccuggaugacguucggaaugugcuuuuccauacaaacgauaacgggaaucagaccaugcgccuguugugcaugcucuacacuccucugcgaucaggagguacaagcaguggcaccgacccauuugucaucgccgggcgugugcugacgugucccacuccugauuucaacuuucucuucuuagugccacccaccgucgaacagaaaacaaagcaauuuuccguuccgaaucugccucuuaacgugaugucuaauagcagaguacccuccuugcugaacgcaaugguggucucaccagaccaggcucaggugguucaguuccaaaauggaaggugcacucuagauggccagaugcucgguaccacaaccgugagugccagcugugucgcgcgguuucgcgggaaaacguuccaggccccugacaacagacugggaauaaaucuugcagagauuucuggcgagcccuaucacgcuuucgaauccccagcuccccugggcuuuccugacuucggggauggagacuggcaugugacugccacaaagguaaccccaucacaauuggaggccaacgauccgguuguggucgguaaugugcagcccuacaacccucaguuugcaccacaccucggcacucuggucguggaaaaucccacaccugaccagguugccaccgggacggauuuacuguucaacaucaccuggcucagcaauagggcuaacaaccgguuuaauccaugggugauucccaacuauggaaguacacuuacugaggcggcacaacuggccccgucuaucuucccuccaggcuuuggugagaccaucguauacuucaauuccacauuucccgcugucggggccacuacccacgcagccauuccuugcuugcuaccccaggaguucguggcucauuuuguuaacgaacaggccccaauacgcggcgaagcagcgcugcuccacuauaucgacccugauacacaucgaaaucugggagaguucaagauuuaccccgaaggcuuugugaccugugucccaaacguagggggaacugguccgcagagccuuccuacgaauggcguguucguguucguuucgugggucucuagauacuaucaacugaaacccguggggacagcuggacaggccaggcgguuguga

SEQ ID NO: 20076 - RNA, 1629 nt, Artificial Sequence
  derived and/or modified sequence opt3 from VP1__Norovirus_and/or_Norovirus-like__AY134748
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaggauaacgaccaucuguauaauaucaccauuacgaacuuaaaugguucacccuucgacccuagugaagauaucccagcuccgcuggggguccccgacuuccaaggaaggguguuuggcguaauaacucagcgggauaagcagaacgccgcuggccaaagccagccugccaaucgcgggcacgacgcaguugugccaacauacaccgcccaguacacucccaaacucggacagguccaaauugguacauggcagaccgaugaccuuaaggugaaccagccugucaaauucacgccagugggccugaaugauaccgagcacuuuaaccaguggguugugccccgauaugcuggggcguugaaucuaaacacaaaucuggcaccgucuguagccccugucuucccaggagaaagacuccuguuuuucagguccuaccuuccccugaagggcgguuaugggaacccugcuaucgacugcuugcucccccaagagugggugcagcauuuuuaccaggaggccgcaccaucaaugagcgaaguugcccuggugcgguauauuaauccugauacuggccgugcuuuauucgaggccaaacugcaccgcgcaggauuuaugaccgucaguucuaacacauccgcgcccgugguagugccagcuaacggcuacuucagauuugacagcuggguuaaucaguucuauucgcuagccccgauggggacuggaaacgguaggcggcgaauccaauga

SEQ ID NO: 20077 - RNA, 1629 nt, Artificial Sequence
  derived and/or modified sequence opt3 from VP1__Norovirus_and/or_Norovirus-like__AY054300
augaagauggccagcaacgacgcugcacccuccaccgauggcgccgcggggcuggugccugagucuaauucagaagucauggcucucgagccaguugccggagcagcccuugcugcaccggugacaggucagacuaacaucauugaccccuggauaagagccaauuucguacaagcuccuaacggcgaauuuacggugaguccaaggaaugcccccggggagguccuguugaacuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuuccccgugccaauagaucagauguuuaccucucccaacgaggucaucagcgugcagugucagaacgguagaugcacacuugacggcgaacugcaagggacuacccaguugcagguuuccggaauuugugccuucaagggcgaggugacagcacaccuccaugauaaugaccaccuguacaacgucaccaucacgaauuuaaacgguucaccuuucgacccaagugaagauauuccggcuccccugggggugccugacuuucagggaaggguauucggcguuaucagccaacgggauaagcagaaugccgcuggccacucugagccagccaaccgcgggcaugacgcagugguccccacuuauacagcccaguacaccccuaaacucggacaaauacagauugguacuuggcagacagaugaccuucaggugaaucaaccagucaaguuuacccccgugggccugaacgauacggaacacuucaaucaguggguugugccgcgauacgcuggggcguugaaccuaaauaccaaccuggcaccuuccguagccccagucuuucccggagagagacuccuguucuuuaggucauaucuuccucugaaaggcgguuacgggaaucccgcuaucgacugcuugcucccacaggagugggugcagcauuucuaucaagaagccgcaccuagcaugagugagguugcccuggugcgguacauuaaccccgauacaggccgugcuuuauuugaagccaagcugcaccgcgcaggauucaugacugucucuuccaauaccagcgcgccagugguagugccggcuaacggcuauuuuagauucgacucguggguuaaccaguuuuacucucuagccccuauggggacaggaaaugguaggcggcgaguccaguga

SEQ ID NO: 20078 - RNA, 1629 nt, Artificial Sequence
  derived and/or modified sequence opt3 from VP1__Norovirus_and/or_Norovirus-like__KY485125
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccaguggaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgagaucauuagcguccagugucagaaugguagaugcacacuugacggcgaacugcaagggacuacccaguugcaggucuccggaaucugugccuuuaagggcgagguuacagcacaccuccaugauaacgaccaccuguauaaugugaccauuacgaacuuaaaugguucacccuucgacccuagugaagauaucccagcuccgcuggggguccccgacuuccagggaaggguguuuggcauaauuagccaacgggauaagcacaacucuccuggccauaaugagccagccaaccgcgggcacgacgcuguaguucccacuuacacagcccaguacaccccuaaacucggacagauccaaauugguacuuggcagacagaugaccuuaccgugaaucagccagucaaguucacgcccgugggccugaacgauaccgaacauuuuaaucagugggucgugccgcgauaugcaggggccuugaaccuaaauacaaaccuggcuccuuccguugcgccaguguuccccggagagagacuccuguuuuucaggucauacaucccucuuaaaggcgguuaugggaaucccgcaaucgacugccuguugccacaagaguggguacagcacuuuuaccaggaagccgcuccuagcaugagugaggucgcccucgugcgguauauuaaccccgauacuggccgugcacuguucgaagccaaguuacaccgcgcuggauuuaugaccguuucuuccaacacaagcgccccaguggucgugccggcaaauggcuacuucagauuugacucguggguaaaccaguucuauucucuggcgccuauggggacuggaaaugguaggcggcgagugcaauga

SEQ ID NO: 20079 - RNA, 1629 nt, Artificial Sequence
  derived and/or modified sequence opt3 from VP1__Norovirus_and/or_Norovirus-like__KY485123
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggccaugccggugggauggaggugcagguuaugcuugcuggaaacgccuucaccgcaggcaaacugguguuugcugccgugcccccucacuucccagucgaaaauuugaguccgcagcagaucacaauguuuccccauguaauuaucgauguucgcacucucgagccugugcugcugccacuccccgacguccgaaacaauuucuuucacuacaaccaaaaggaugacccuaaaaugcguauuguggcgauguuauauaccccacugagaagcaauggcuccggggaugacguguucacagucucuugcaggguucuuacccggcccucgccggauuuugacuucacuuacuuggugccucccacaguagaaucaaagaccaaaccauuuacgcugccuauccuaacucucggagagcugagcaacagucgcuuccccguguccauagaucagauguauaccucuccaaacgaggucaucagcgugcagugucagaaugguagaugcacacuugacggcgaacugcaagggacuacccaguugcagguuuccggaauuugugccuuuaagggcgaggugacagcacaucuccacgauaacgaccaccuguacaaugucaccaucacgaacuuaaaugguucacccuucgacccuagugaagauauuccagcuccgcugggggugcccgacuuccagggaaggguauuuggcaucauaagccaacgggauaagcauaacucuccuggccacaaugagccagccaaccgcgggcaugacgcuguugugcccacuuauacagcccaguacaccccuaaacucggacagauucaaaucgguacuuggcagacagaugaccuuaccgucaaucagccagugaaguucacgcccgucggccugaacgauaccgaacacuuuaaucagugggugguuccgcgauacgcaggggccuugaaccuaaauacaaaccuggcuccuuccguggcgccaguauuccccggagagagacuccuguuuuucaggucauauauuccucuuaaaggcgguuacgggaaucccgcaaucgacugccuguugccacaagaguggguccagcacuuuuaucaggaagccgcuccuagcaugagugagguggcccucguucgguacaucaaccccgauacuggccgugcacuguucgaagccaaguuacaucgcgcuggauuuaugaccgugucuuccaacacaagcgccccagucgugguaccggcaaauggcuauuucagauuugacucgugggugaaccaguucuacucucuggcgccuauggggacuggaaaugguaggcggcgaguucaauga

SEQ ID NO: 20080 - RNA, 1629 nt, Artificial Sequence
  derived and/or modified sequence opt3 from VP1__Norovirus_and/or_Norovirus-like__KY485126
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccaguggaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgagaucauuagcguccagugucagaaugguagaugcacacuugacggcgaacugcaagggacuacccaguugcaggucuccggaaucugugccuuuaagggcgagguuacagcacaccuccaugauaacgaccaccuguauaaugugaccauuacgaacuuaaaugguucacccuucgacccuagugaagauaucccagcuccgcuggggguccccgacuuccagggaaggguguuuggcauaauuagccaacgggauaagcacaacucuccuggccauaaugagccagccaaccgcgggcacgacgcuguaguucccacuuacacagcccaguacaccccuaaacucggacagauccaaauugguacuuggcagacagaugaccuuaccgugaaucagccagucaaguucacgcccgugggccugaacgauaccgaacauuuuaaucagugggucgugccgcgauaugcaggggccuugaaccuaaauaucaaccuggcuccuuccguugcgccaguguuccccggagagagacuccuguuuuucaggucauacaucccucuuaaaggcgguuaugggaaucccgcaauugacugccuguugccacaagaguggguacagcacuuuuaccaggaagccgcuccuagcaugagugaggucgcccucgugcgguauauaaaccccgauacaggccgugcacuguucgaagccaaguuacaccgcgcuggauuuaugacuguuucuuccaacaccagcgccccaguggucgugccggcaaauggcuacuucagauuugacucguggguaaaccaguucuauucucuggcgccuauggggacaggaaaugguaggcggcgagugcaauga

SEQ ID NO: 20081 - RNA, 1629 nt, Artificial Sequence
  derived and/or modified sequence opt3 from VP1__Norovirus_and/or_Norovirus-like__U70059
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccucaaagggcgaggugacagcacaccuccaggauaacgaccaucuguauaauaucaccauuacgaacuuaaaugguagucccuuugacccuagcgaagauaucccagcuccgcuggggguccccgacuuccaaggaaggguguucggcguaauaacucagcgggauaagcagaacgccgcuggccaaucucagccugccaaucgcgggcacgacgcaguugugccaacauacaccgcccaguacacucccaaacucggacagguccaaauugguacauggcagaccgaugaccuuaaggugaaccagccugucaaauuuacgccagugggccugaaugauaccgagcacuucaaccaguggguugugccccgauaugcuggggcguugaaucuaaacacaaaucuggcaccguccguagccccugucuuuccaggagaaagacuccuguucuuuaggucauaccuuccccugaagggcgguuaugggaacccugcuaucgacugcuugcucccccaagagugggugcagcauuucuaccaggaggccgcaccaagcaugagugaaguugcccuggugcgguauauuaauccugauacuggccgugcuuuauuugaggccaaacugcaccgcgcaggauucaugaccgucucuuccaacacaagcgcgcccgugguagugccagcuaacggcuacuuuagauucgacucguggguuaaucaguuuuauucucuagccccgauggggacuggaaacgguaggcggcgaguccaauga

SEQ ID NO: 20082 - RNA, 1629 nt, Artificial Sequence
  derived and/or modified sequence opt3 from VP1__Norovirus_and/or_Norovirus-like__LC145808
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacgcuccuggccauaaugagccagccaaccgcgcucacgacgccgugguccccacuuacacagcacaguacaccccuaaacucgggcagauacaaauuggaacuuggcagacagaugaccuuaccgugaaucagccagucaaguucacgcccgugggucugaacgauaccgaccauuuuaaucaguggguugugccgcgauaugccggcgcuuugaaccuaaauacaaaccuggcgccuuccguagcaccagucuuccccggggaaagacuccuguuuuucaggucauacaucccucuuaaaggaggcuaugguacucccgccauugauugccuguugccacaagagugggugcagcacuuuuaccaggaggcugccccuagcaugagugaaguugcacucgugcgguauaucaaucccgacaccgggcgugcccuguucgaggcuaaguuacaccgcgccggcuuuaugacagucucuuccaacacuagcgcaccagugguagugccggcgaacggauacuucagauuugauucguggguuaaucaguucuauucucuggcuccuaugggcaccgggaacggaaggcggcgaauccaauga

SEQ ID NO: 20083 - RNA, 1629 nt, Artificial Sequence
  derived and/or modified sequence opt3 from VP1__Norovirus_and/or_Norovirus-like__LC145795
augaagauggccagcaacgacgcugcacccuccaccgauggcgccgcggggcuggugccugagucuaauaacgaagucauggcucucgagccaguugccggagcagcccuugcugcaccggugacaggucagacuaauauuauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacgaucaaucagccagugaaguucacccccgucggucugaacgauacagaccauuuuaaucagugggugguuccgcgauaugcaggcgccuugaaccuaaauacuaaccuggcuccuuccguggcgccaguauuccccggggaaagacuccuguuuuucaggucauacauuccucuuaaaggaggcuaugguacccccgcaaucgauugccuguugccacaagaguggguccagcacuuuuaccaggaggccgcuccuagcaugagugaaguggcccucguucgguauaucaaucccgacacagggcgugcacuguucgaggccaaguuacaccgcgcuggcuuuaugacugugucuuccaacaccagcgccccagucgugguaccggcaaacggauacuucagauuugauucgugggugaaucaguucuauucucuggcgccuaugggcacagggaacggaaggcggcgaauccaauga

SEQ ID NO: 20084 - RNA, 1629 nt, Artificial Sequence
  derived and/or modified sequence opt3 from VP1__Norovirus_and/or_Norovirus-like__AB629941
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggcuuuauaauggcuacgccggugggauggaggugcagguuaugcuggcuggaaacgccuucaccgcaggcaaauugguguuucccgcugucccuccacauuucccgaucgaaaaucucaguccccagcagauuacaauguuuccucacgugaucauugauguacgcacucuggagccaguucugcuccccuuaccugacgugcgaaacaauuucuuucauuauaaccaaaaggaugacccaaaaaugcguaucgucgccaugcuguacacaccccuuagaagcaauggcuccggggaugacguguucaccgugucuugcagggucuugacccggccgucgccugauuuugacuucacuuaucugguucccccaacaguggaaucaaagaccaaaccuuuuacgcuacccauacucacucugggagagcuuagcaacagucgcuucccaguauccaucgaucagauguacaccucucccaacgaggugauuagcguccagugucagaaugguagaugcacacuggacggcgaauugcaagggacuacccagcuccagguguccggaaucugugcguuuaagggcgagguuacagcccaccuucaugauaacgaccacuuauauaauauuaccaucacgaaccugaaugguucaccuuucgacccaagugaagauauaccggcaccccucggggugccugacuuccagggaagggucuuuggcauuaucagccaacgggauaagcacaacucuccaggccauaaugagcccgcuaaccgcgggcacgacgccgugguaccuacuuacacagcucaguacaccccaaaacuuggacagauucaaaucgguacuuggcagacagaugaccugaccguuucccagcccgugaaguucacgccggucggcuugaaugauaucgaacauuuuaaccaguggguggucccucgauaugccggggcacuaaaucugaacaccaaucucgccccaucaguggcucccguuuucccuggagagagacugcuguuuuucaggagcuacauuccccugaaaggcgguuaugggaacccagcgauagacugcuugcucccucaagagugggugcagcacuuuuaccaggaagcagcccccaguaugucugagguagcucugguccgguauaucaauccagauacaggccgugccuuauucgaagcaaagcugcaccgcgccggauuuaugacuguguccagcaacaccucggcuccgguuguggucccugccaacggcuacuucagauuugacucuugggugaaucaguucuauucccuagcacccauggggacaggaaacgguaggcggcgaguacaauga

SEQ ID NO: 20085 - RNA, 1629 nt, Artificial Sequence
  derived and/or modified sequence opt3 from VP1__Norovirus_and/or_Norovirus-like__LC145792
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaaguucacccccgugggucugaacgauacagaccauuuuaaucaguggguuuugccgcgauaugcaggcgcccuaaaccugaauacuaaccucgcuccuuccguggcgccaguauuccccggggaaagacugcuguuuuucaggucauacaucccucuuaaaggaggcuaugguacccccgcaauugauugcuugcucccacaagaguggguccagcacuuuuaccaggaggccgcuccuagcaugagugaaguggcccugguucgguauaucaaucccgacacagggcgugcauuauucgaggccaagcugcaccgcgcuggcuuuaugacugugucuuccaacaccagcgccccagucgugguaccggcaaacggauacuucagauuugauucgugggugaaucaguucuauucucuagcgccuaugggcacagggaacggaaggcggcgaauccaauga

SEQ ID NO: 20086 - RNA, 1629 nt, Artificial Sequence
  derived and/or modified sequence opt3 from VP1__Norovirus_and/or_Norovirus-like__LC145786
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauucccaaaaggaugacccuaaaaugcguauuguggccauguuauacaccccacugagaucuaacggcucgggggaugacguguucacagucucaugcaggguucuuacccggcccagcccggauuuugacuucacuuauuuggugccucccacaguagaaaguaagaccaaaccauuuacgcugccuauccuaacucucggagagcuguccaauucucgcuuccccgugagcauagaucagauguacaccuccccaaacgaggucaucucagugcagugucagaacgguagaugcacacuugacggcgaacugcaagggacuacccaguugcagguuaguggaauuugugcguuuaagggcgaggugacagcccaccuccaugauaaugaccaccuguauaacgucaccaucacgaauuuaaacgguagccccuucgacccuucugaagauauuccagcaccgcugggggugcccgacuuccagggaaggguauuuggcguuaucucccaacgggauaagcacaauacuccuggccauaacgagccagcuaaucgcgcccacgacgcugugguccccacauacaccgcccaguacacuccuaaacucgggcagauacaaauuggaacauggcagaccgaugaccuuacggugaaccagccagucaaguucacccccgugggucugaaugauacagaccauuuuaaccaguggguugugccgcgauaugcaggcgccuugaaucuaaacacuaaucuggcuccuucaguagcgccagucuuccccggggaaagacuccuguuuuucaggagcuacaucccucuuaaaggaggcuaugguacccccgcaauugauugccuguugccacaagagugggugcagcacuuuuaccaggaggccgcuccuaguaugucugaaguugcccucgugcgguauaucaaccccgacacagggcgugcacuguucgaggccaaguuacaccgcgcuggcuuuaugacugucuccagcaauaccucggccccagugguagugccggcaaacggauacuucagauuugauucuuggguuaaccaguucuauucccuggcgccuaugggcacagggaauggaaggcggcgaauccaauga

SEQ ID NO: 20087 - RNA, 1629 nt, Artificial Sequence
  derived and/or modified sequence opt3 from VP1__Norovirus_and/or_Norovirus-like__LC145793
augaagauggccagcaacgacgcugcacccuccaccgauggcgccgcggggcuggugccugagucuaauaacgaagucauggcucucgagccaguugccggaguggcacuugccgcuccgguaacaggucagacuaauaucauugaccccuggauaagagcaaacuucgugcaagccccuaauggcgaauuuacggucucaccaaggaacagucccggggaggugcuguugaauuuagaacugggaccugagcuaaacccauaccucgcucaccuggcccggauguauaauggcuacgcgggugggauggagguucaggugaugcuugcaggaaacgccuucaccgcuggcaaacuggucuuugccgcagugcccccucauuucccaguagaaaauuugagcccgcagcagaucacaauguuuccccacguuauuaucgaugugcgcacucucgagccuguccugcugccacuccccgacgugcgaaacaauuucuuucauuauaaccaaaaggaugacccuaaaaugcguauuguggcuauguuauacaccccacugagauccaauggcucuggggaugacgucuucacaguuucgugcagggugcuuacccggcccucaccggauuuugacuucacuuauuugguaccucccacaguggaaagcaagaccaaaccauuuacgcugccuauccuaacucucggagagcugaguaacucccgcuuccccgucucuauagaucagauguacaccagcccaaacgaggugaucuccguucagugucagaaugguagaugcacacuugacggcgaacugcaagggacuacccagcuccaggugucaggaauuugugccuuugagggcgaagucacagcgcacuugcaugauaacgaccaccuguauaaugugaccaucacgaacuuaaaugguagucccuucgacccuagcgaggauauuccagccccgcuggggguacccgacuuccagggaaggguuuuuggcgugaucucucaacgggauaagcacaacacuccuggccauaaugaaccagcaaaccgcgcucacgacgccgucgugcccacauacaccgcucaguacacuccuaagcucgggcagauacaaauuggaacauggcagaccgaugaccuuacggucaaucagccagugaaauucacccccguuggucugaacgauacagaccauuuuaaucagugggugguaccgcgauaugccggcgcauugaaccuaaauacuaaccuggccccuuccgucgcuccaguguuccccggggagagacuccuguuuuucaggucauacaucccucuuaagggaggcuaugguacccccgcgauugauugccuguugccacaagaguggguucagcacuuuuaccaggaagcagccccuagcaugagugagguggcucucguccgguauaucaaucccgacacagggcgugcccuguucgaagcaaaauuacaccgcgccggcuuuaugacugugucuuccaacaccagcgcuccaguagugguuccggccaacggauacuucagauuugauucgugggucaaucaguucuauucucuggcaccuaugggcacagggaacggaaggcggcgaauccaauga

SEQ ID NO: 20088 - RNA, 1629 nt, Artificial Sequence
  derived and/or modified sequence opt3 from VP1__Norovirus_and/or_Norovirus-like__LC145791
augaagauggccagcaacgacguggcucccuccaccgauggcgcagccgggcuggucccugagucuaauaacgaaguuauggcgcucgagccaguggcuggagccgcacuugccgcuccgguaacaggucagacuaauaucauugaccccuggauaagagcaaacuucgugcaagccccuaauggcgaauuuacggucucaccaaggaacagucccggggaggugcuguugaauuuagaacugggaccugagcuaaacccauaccucgcucaccuggcccggauguauaauggcuacgcgggugggauggagguucaggugaugcuugcaggaaacgccuucaccgcuggcaaacuggucuuugccgcagugcccccucauuucccaguagaaaauuugagcccgcagcagaucacaauguuuccccacguuauuaucgaugugcgcacucucgagccuguccugcugccacuccccgacgugcgaaacaauuucuuucauuauaaccaaaaggaugacccuaaaaugcguauuguggcuauguuauacaccccacugagauccaauggcucuggggaugacgucuucacaguuucgugcagggugcuuacccggcccucaccggauuuugacuucacuuauuugguaccucccacaguggaaagcaagaccaaaccauuuacgcugccuauccuaacucucggagagcugaguaacucccgcuuccccgucucuauagaucagauguacaccagcccaaacgaggugaucuccguucagugucagaaugguagaugcacacuugacggcgaacugcaagggacuacccagcuccaggugucaggaauuugugccuuuaagggcgaggucacagcgcacuugcaugauaacgaccaccuguauaaugugaccaucacgaacuuaaaugguagucccuucgacccuagcgaagauauuccagccccgcuggggguacccgacuuccagggaaggguuuuuggcgugaucucucaacgggauaagcacaacacuccuggccauaaugagccagcaaaccgcgcucacgacgccgucgugcccacauacaccgcucaguacacuccuaaacucgggcagauacaaauuggaacauggcagaccgaugaccuuacggucaaucagccagugaaguucacccccguuggucugaacgauacagaccauuuuaaucagugggugguaccgcgauaugccggcgcauugaaccuaaauacuaaccuggccccuuccgucgcuccaguguuccccggggaaagacuccuguuuuucaggucauacaucccucuuaaaggaggcuaugguacccccgcgauugauugccuguugccacaagaguggguucagcacuuuuaccaggaggcagccccuagcaugagugaaguggcucucguccgguauaucaaucccgacacagggcgugcccuguucgaggcaaaguuacaccgcgccggcuuuaugacugugucuuccaacaccagcgcuccaguagugguuccggccaacggauacuucagauuugauucgugggucaaucaguucuauucucuggcaccuaugggcacagggaacggaaggcggcgaauccaauga

SEQ ID NO: 20089 - RNA, 1629 nt, Artificial Sequence
  derived and/or modified sequence opt3 from VP1__Norovirus_and/or_Norovirus-like__LC145788
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuugcagugaaucagccagucaaguucacgcccgugggucugaacgauaccgaccauuuuaaucaguggguugugccgcgauaugccggcgcuuugaaccuaaauacaaaccuggcgccuuccguagcaccagucuuccccggggaaagacuccuguuuuucaggucauacaucccucuuaaaggaggcuaugguacucccgccauugauugccuguugccacaagagugggugcagcacuuuuaccaggaggcugccccuagcaugagugaaguugcacucgugcgguauaucaaucccgacaccgggcgugcccuguucgaggcuaaguuacaccgcgccggcuuuaugacagucucuuccaacacuagcgcaccagugguagugccggcgaacggauacuucagauuugauucguggguuaaucaguucuauucucuggcuccuaugggcaccgggaacggaaggcggcgaauccaauga

SEQ ID NO: 20090 - RNA, 1629 nt, Artificial Sequence
  derived and/or modified sequence opt3 from VP1__Norovirus_and/or_Norovirus-like__LC145803
augaagauggccagcaacgacgcugcacccuccaccgauggcgccgcggggcuggugccugagucuaauaacgaagucauggcucucgagccaguugccggagcagcccuugcugcaccggugacaggucagacuaauauuauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguaguagcuucgaccccucugaagauauuccugcaccacuggggaucccggacuuccagggaaggguguuuggcguaauaucccaacgggauaagcacaacacucccggccauaaugagccugcuaaccgcgcccacgacgcuguugugccaacauacaccgcccaguacacucccaaacucgggcagauucaaaucggaacauggcagaccgaugaccuuacggucaaucagccugugaaguucaccccagucggucugaacgauacagaccauuuuaaucagugggugguuccccgauaugcaggcgccuugaaccuaaauacuaaccuggcuccgucaguggcgccuguauucccaggggaaagacuccuguuuuucaggagcuacauuccccuuaaaggaggcuaugguaccccugcaaucgauugccuguugccccaagaguggguccagcacuuuuaccaggaggccgcuccaaguaugucugaaguggcccucguucgguauaucaauccugacacagggcgugcacuguucgaggccaaguuacaccgcgcuggcuuuaugacuguguccagcaacaccucggcccccgucgugguaccagcaaacggauacuucagauuugauucuugggugaaucaguucuauucccuggcgccgaugggcacagggaacggaaggcggcgaauccaauga

SEQ ID NO: 20091 - RNA, 1629 nt, Artificial Sequence
  derived and/or modified sequence opt3 from VP1__Norovirus_and/or_Norovirus-like__LC145804
augaagauggccagcaacgacgcugcacccuccaccgauggcgccgcggggcuggugccugagucuaauucagaagucauggcucucgagccaguugccggagcagcccuugcugcaccggugacaggucagacuaacaucauugaccccuggauaagagccaauuucguacaagcuccuaacggcgaauuuacggugaguccaaggaauagccccggggagguccuguugaacuuagaacugggaccugagcuaaauccauaccucgcccaccuggcgcggauguauaacggcuacgccggugggauggaggugcagguuaugcuugcaggaaaugcuuucaccgccggcaaacugguguuugcagcugugcccccucauuucccagucgaaaacuuguccccgcagcagaucacaauguuuccccacguaauuaucgauguucgcacucucgagccugugcugcugccacuccccgacguccgaaauaacuucuuucauuauaaucaaaaggaugacccuaaaaugcguauuguggccauguuauacaccccacugagaucuaacggcucgggggaugacguguucacagucucaugcaggguucuuacccggcccagcccggauuuugacuucacuuauuuggugccucccacaguagaaaguaagaccaaaccauuuacgcugccuauccuaacucucggagagcuguccaauucucgcuuccccgugagcauagaucagauguacaccuccccaaacgaggucaucucagugcagugucagaacgguagaugcacacuugacggcgaacugcaagggacuacccaguugcagguuaguggaauuugugcguuuaagggcgaggugacagcccaccuccaugauaaugaccaccuguauaacgucaccaucacgaauuuaaacgguagccccuucgacccuucugaagauauuccagcaccgcugggggugcccgacuuccagggaaggguauuuggcguuaucucccaacgggauaagcacaauacuccuggccauaacgagccagcuaaucgcgcccacgacgcugugguccccacauacaccgcccaguacacuccuaaacucgggcagauacaaauuggaacauggcagaccgaugaccuugcagugaaccagccagucaaguucacgcccgugggucugaaugauaccgaccauuuuaaccaguggguugugccgcgauaugccggcgcuuugaaucuaaacacaaaucuggcgccuucaguagcaccagucuuccccggggaaagacuccuguuuuucaggagcuacaucccucuuaaaggaggcuaugguacucccgccauugauugccuguugccacaagagugggugcagcacuuuuaccaggaggcugccccuaguaugucugaaguugcacucgugcgguauaucaaccccgacaccgggcgugcccuguucgaggcuaaguuacaccgcgccggcuuuaugacagucuccagcaauacuucggcaccagugguagugccggcgaacggauacuucagauuugauucuuggguuaaccaguucuauucccuggcuccuaugggcaccgggaauggaaggcggcgaauccaauga

SEQ ID NO: 20092 - RNA, 1629 nt, Artificial Sequence
  derived and/or modified sequence opt3 from VP1__Norovirus_and/or_Norovirus-like__LC145801
augaagauggccagcaacgacgcugcacccuccaccgauggcgccgcggggcuggugccugagucuacaaaugaagucauggcucucgagccaguugccggagcagcccuugcugcaccggugacuggucagacgaacaucauugaccccuggauaagagccaauuucguacaagcuccuaacggcgaauuuaccgugucaccaaggaauagucccggggagguccuguugaacuuagaacugggaccugagcuaaauccauaccucgcccaccuggcgcggauguauaacggcuacgccggugggauggaggugcagguuaugcuugcaggaaaugcuuucacagccggcaaacugguguuugcagcugugcccccucauuucccagucgaaaacuugagcccgcagcagaucacuauguuuccccacguaauuaucgauguucgcacccucgagccugugcugcugccacuccccgacguccgaaauaacuucuuucauuauaaucaaaaggaugacccuaaaaugcguauuguggccauguuauacacaccacugagauccaacggcucuggggaugacguguucaccgucucgugcaggguucuuacucggcccucaccggauuuugacuucacauauuuggugccucccaccguagaaagcaagacgaaaccauuuacucugccuauccuaacccucggagagcugaguaauucccgcuuccccgugucuauagaucagauguacacaagcccaaacgaggucaucuccgugcagugucagaacgguagaugcacucuugacggcgaacugcaagggaccacacaguugcagguuucaggaauuugugcguuuaagggcgaggugaccgcccaccuccaugauaaugaccaccuguauaacgucacgaucacuaauuuaaacgguagucccuucgacccuagcgaagauauuccagcaccgcugggggcucccgacuuccagggaaggguguuuggcguaaucucucaacgggauaagcacaauacaccuggccauaacgagccagccaaucgcgcucacgacgccguugugcccaccuacacugcacaguacacaccuaaacucgggcagauacaaauuggaaccuggcagacggaugaccuuaccgucaaccagccagugaaguucacacccgucggucugaaugauacugaccauuuuaaccagugggugguuccgcgauaugccggcgcuuugaaucuaaacaccaaucuggcgccuuccguggcaccaguauuccccggggaaagacuccuguuuuucaggucauacaucccucuuaaaggaggcuaugguacacccgccauugauugccuguugccacaagaguggguccagcacuuuuaccaggaggcugccccuagcaugagugaaguggcacucguucgguauaucaaccccgacacugggcgugcccuguucgaggcuaaguuacaccgcgccggcuuuaugaccgugucuuccaauacaagcgcaccagucgugguaccggcgaacggauacuucagauuugauucgugggugaaccaguucuauucucuggcuccuaugggcaccgggaauggaaggcggcgaauccaauga

SEQ ID NO: 20093 - RNA, 1629 nt, Artificial Sequence
  derived and/or modified sequence opt3 from VP1__Norovirus_and/or_Norovirus-like__LC145802
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggccaugccggugggauggaggugcagguuaugcuugcaggaaacgcuuucaccgccggcaaacugguguuugcagcugugcccccucacuucccagucgaaaauuugagcccgcagcagaucacaauguuuccccauguaauuaucgauguucgcacucucgagccugugcugcugccacuccccgacguccgaaacaauuucuuucacuacaaccaaaaggaugacccuaaaaugcguauuguggccauguuauauaccccacugagauccaauggcucuggggaugacguguucacagucucgugcaggguucuuacccggcccucaccggauuuugaguucacuuacuuggugccucccacaguagaaagcaagaccaaaccauuuacgcugccuauccuaacucucggagagcugaguaacucccgcuuccccgugucuauagaccagauguauaccagcccaaacgaagucaucuccgugcagugucagaaugguagaugcacacuugauggcgagcugcaagggacuacccaguugcaggcgucaggaauuugugccuuuaagggcgaaguuacagcacaucuccacgacaacgaucaccuguacaaugugaccaucacgaacuuaaaugguagucccuucgacccuagcgaggacauuccagcuccgcuggggguccccgauuuccagggaaggguguuuggcguaaucucucaacgggacaagcauaacgccccuggccacaaugaaccagcuaaccgcgcccaugaugcaguugugcccacuuauacagcccaguacaccccuaaacucgggcagauacaaauuggaacuuggcagacagacgaucuuaccgucaaucagccagugaaguucacgcccgucggucugaacgacaccgaucacuuugaccagugggugguuccgcgauacgcuggcgcguugaaucuaaacacaaaucuggcaccuuccguggccccaguauuccccggggagagacuccuguuuuucaggucauauaucccucuuaaaggaggcuacgguacucccgcuauugauugccuguugccacaagaguggguccagcacuuuuaucaggaagccgcaccuagcaugagugagguggcccucguucgguacaucaaccccgacaccgggcgugcucuguucgaagccaaguuacaucgcgcaggcuuuaugacagugucuuccaauacuagcgcgccagucgugguaccggcuaacggauauuucagauuugauucgugggugaaccaguucuacucucuggccccuaugggcaccgggaauggaaggcggcgaauccaauga

SEQ ID NO: 20094 - RNA, 1629 nt, Artificial Sequence
  derived and/or modified sequence opt3 from VP1__Norovirus_and/or_Norovirus-like__LC145805
augaagauggccagcaacgacgcugcacccuccaccgauggcgccgcggggcuggugccugagucuaauucagaagucauggcucucgagccaguugccggagcagcccuugcugcaccggugacaggucagacuaacaucauugaccccuggauaagagccaauuucguacaagcuccuaacggcgaauuuacggugaguccaaggaauagccccggggagguccuguugaacuuagaacugggaccugagcuaaauccauaccucgcccaccuggcgcggauguauaacggcuacgccggugggauggaggugcagguuaugcuugcaggaaaugcuuucaccgccggcaaacugguguuugcagcugugcccccucauuucccagucgaaaacuuguccccgcagcagaucacaauguuuccccacguaauuaucgauguucgcacucucgagccugugcugcugccacuccccgacguccgaaauaacuucuuucauuauaaucaaaaggaugacccuaaaaugcguauuguggccauguuauacaccccacugagaucuaacggcucgggggaugacguguucacagucucaugcaggguucuuacccggcccagcccggauuuugacuucacuuauuuggugccucccacaguagaaaguaagaccaaaccauuuacgcugccuauccuaacucucggagagcuguccaauucucgcuuccccgugagcauagaucagauguacaccuccccaaacgaggucaucucagugcagugucagaacgguagaugcacacuugacggcgaacugcaagggacuacccaguugcagguuaguggaauuugugcguuuaagggcgaggugacagcccaccuccaugauaaugaccaccuguauaacgucaccaucacgaauuuaaacgguagccccuucgacccuucugaagauauuccagcaccgcugggggugcccgacuuccagggaaggguauuuggcguuaucucccaacgggauaagcacaauacuccuggccauaacgagccagcuaaucgcgcccacgacgcugugguccccacauacaccgcccaguacacuccuaaacucgggcagauacaaauuggaacauggcagaccgaugaccuugcagugaaccagccagucaaguucacgcccgugggucugaaugauaccgaccauuuuaaccaguggguugugccgcgauaugccggcgcuuugaaucuaaacacaaaucuggcgccuucaguagcaccagucuuccccggggaaagacuccuguuuuucaggagcuacaucccucuuaaaggaggcuaugguacucccgccauugauugccuguugccacaagagugggugcagcacuuuuaccaggaggcugccccuaguaugucugaaguugcacucgugcgguauaucaaccccgacaccgggcgugcccuguucgaggcuaaguuacaccgcgucggcuuuaugacaguguccagcaauacuucggccccaguagugguuccggcaaacggauacuucagauuugauucuugggucaaccaguucuauucccuggcgccuaugggcaccgggaauggaaggcggcgaauccaauga

SEQ ID NO: 20095 - RNA, 1629 nt, Artificial Sequence
  derived and/or modified sequence opt3 from VP1__Norovirus_and/or_Norovirus-like__LC145797
augaagauggccagcaacgacgcugcacccuccaccgauggcgccgcggggcuggugccugagucuaauaacgaagucauggcucucgagccaguugccggaguggcacuugccgcuccgguaacaggucagacuaauauuauugaccccuggauaagagcaaacuucgugccugccccaaauggcgaauuuacggucucacccaggaacaguccuggggaggugcuguugaauuuagaacugggaccagagcuaaaccccuaccucgcucaccuggcccggauguauaauggcuacgcgggugggauggagguucaagugaugcuugcaggaaacgccuucaccgcuggcaaacuggucuuugccgcagugccuccacauuucccgguagaaaauuugagcccccagcagaucacaauguuuccucacguuauuaucgaugugcgcacucucgagccaguccugcugccccucccugacgugcgaaacaauuucuuucauuauaaccagaaggaugacccaaaaaugcguauuguggcuauguuauacacaccccugagauccaauggcucuggggaugacgucuucaccguuucgugcagggugcuuacccggccgucaccugauuuugacuucacuuauuugguacccccaacaguggaaagcaagaccaaacuguuuacgcuaccuauccucacucugggagagcuuaguaacucccgcuuccccgucucuauagaucaaauguacaccagcccaaacgaggugaucuccguucagugucagaaugguagaugcacacuggacggcgaauugcaggggacuacccaacuccaggugucaggaauuugugccuuuaagggcgaggucacagcgcaccuucaugauaacgaccacuuauauaaugugaccaucacgaaccugaaugguagucccuucgacccuagcgaagauauuccagccccgcucgggguacccgacuuccagggaaggguuuuuggcgugaucucucagcgggauaagcacaacauauccggccauaaugagccugcaaaccgcgcucacgacgccgucgugccaacuuacacagcucaauacacccccaaacuugggcagauucagaucggaacuuggcaaacagaugaccugaccgucaaucagccugugaaguucacgccaguugguuugaacgauaccgaccauuuuaaucagugggugguaccccgauaugccggcgcacuaaaccugaauacaaaccucgccccgucagucgcuccuguguucccaggggaaagacugcuguuuuucaggagcuacauuccccugaaaggaggcuaugguacuccugcgaucgauugcuugcucccccaggaguggguucaacacuuuuaccaggaggcagccccaaguaugucugaaguggcucugguccgguauaucaauccugacaccgggcgugccuuauucgaggcaaagcugcaccgcgccggcuuuaugacaguguccagcaacacuucggcucccguagugguuccagccaacggauacuucagauuugauucuugggucaaucaguucuauucccuagcaccgaugggcaccgggaacggaaggcggcgaauccaguga

SEQ ID NO: 20096 - RNA, 1629 nt, Artificial Sequence
  derived and/or modified sequence opt3 from VP1__Norovirus_and/or_Norovirus-like__LC145806
augaagauggccagcaacgacgcugcacccuccaccgauggcgccgcggggcuggugccugagucuaauucagaagucauggcucucgagccaguugccggagcagcccuugcugcaccggugacaggucagacuaacauuauugaccccuggauaagagccaucuucguacaagcuccuaauggcgaauuuacggugaguccaaggaacagccccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuuguccccgcagcagauuacaauguuuccccacguaaucauugauguucgcacucucgagccugugcugcugccacuccccgacguccgaaacaauuucuuucauuauaaccaaaaggaugacccuaaaaugcguaucguggccauguuauacaccccacugagaucuaauggcucgggggaugacguguucacagucucaugcaggguucuuacccggcccagcccggauuuugacuucacuuauuuggugccucccacaguagaaaguaagaccaaaccauuuacgcugccuauacuaacucucggagagcuguccaacucucgcuuccccgugagcaucgaucagauguacaccuccccaaaugaggucauuucagugcagugucagaacgguagaugcacacuugacggcgaacugcaagggacuacccaguugcagguuaguggaaucugugcguuuaagggcgaggugacagcccaccuccaugauaacgaccaccuguauaaugucaccauuacgaacuuaaaugguagccccuucgacccuucugaagauaucccagcaccgcugggggugcccgacuuccagggaaggguauuuggcguuauaucccaacgggauaagcacaacacuccuggccauaaugagccagcuaaccgcgcccacgacgcugugguccccacauacaccgcccaguacacuccuaaacucgggcagauucaaaucggaacauggcagaccgaugaccuugcagugaaucagccagucaaguucacgcccgugggucugaacgauaccgaccauuuuaaucaguggguugugccgcgauaugccggcgcuuugaaccuaaauacaaaccuggcgccuucaguagcaccagucuuccccggggaaagacuccuguuuuucaggagcuacauuccucuuaaaggaggcuaugguacucccgccaucgauugccuguugccacaagagugggugcagcacuuuuaccaggaggcugccccuaguaugucugaaguugcacucgugcgguauaucaaucccgacaccgggcgugcccuguucgaggcuaaguuacaccgcgccggcuuuaugacagucuccagcaacacuucggcaccagugguagugccggcgaauggauacuucagauuugauucuuggguuaaccaguucuauucccuggcuccuaugggcaccgggaacggaaggcggcgaauccaauga

SEQ ID NO: 20097 - RNA, 1629 nt, Artificial Sequence
  derived and/or modified sequence opt3 from VP1__Norovirus_and/or_Norovirus-like__KU306738
augaagauggccagcaacgacgcugcacccuccaaugauggcgccucuucacuggugccugagaucaacaaugaaaccauggcgcucgagccagucgcugggggagccauugcagccccgcuuacaggucagacuaacuucauagaccccuggaucagaaauaacuacguucaagcuccuaauggcgaauuuacgauuaguccaaggaacagccccggggagauccuguugaauuuagaacugggaccugagcuaaacccauuccucgcacaccuggcccggauguauaauggcuacgcuggugggguggauguacaggugauuauggccggaaacgcguuuaccgcaggcaaagucaucuucgccgcugugcccccucauuuuccaguugagucccuuucuccgccccagauaacaauguucccucacaucauuguggacguccgcacucuggaaccaaucaauauucccaucccugaugugcgaaacaacuuuuuccauuauaaucagaacaaugagccacguaugagauugguagccaugcucuacacaccccugaggucgaacggcucagcagacgauguuuuuaccgugagcugccggguccugaccaagccgagugcugacuucgaauuuaauuaucucgugccucccacuguggagucccgcacaaaaccauucaccauaccuauuuuaacgaucggggagaugacuaacucuagauuucccgucgccauugauaugcuguacaccagcccaacagaaaaucuuguugugcaaccccagaacggaagguguacuuuggagggugaacugcuaggcaccacacagcucguaaccccuaauaucugcucccugcgcggggcgaucacgggacacgagggcaacgacgauaaucauaaguggcacaugacugugacaaacccaaaugguucagccuucgacccgaccgaagauguccccgcaccucuugggacuccagacuucauuggagacguguauggcguucugagucagcggaaccgaaauauagagagcggccaaacagcucccgccaacagaucucacgaggcugugaucuccaccaggucaaauaaauuuacgccuaaguuggggagcgucaugauugccaccuggaacacaaacgauguggaaaaucagccaacuaaguucacccccguaggacucgagaacccggguaguuuucaucagugggaacugccuaauuacucuggcgcauuaacacugaacauggggcucgccccacccguuuucccuacuuaccccggagagcagcuucuguuuuuccgguccuauaucccauugaaaggcgguuuugggaauagcauaauugacugucuagugccucaagaauggauccagcacuucuaccaggagucggcucccucucaaaccgaugucgcgcugauccguuaugugaacccagagacaggccgcguccucuuugaagcaaagcugcauagacagggauucauuaccguggccaaaacuggcgacuccccgaucaauguuccugcuaacggguacuuuagguucgauucaugggugaauaguuuuuauagccuugcccccaugggaacggguaacggccggcgacgcauucaguga

SEQ ID NO: 20098 - RNA, 1629 nt, Artificial Sequence
  derived and/or modified sequence opt3 from VP1__Norovirus_and/or_Norovirus-like__KM036380
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggcgauuuacccccaagauuggaacgauagguuugcauuccaucaccgaaaauguccacccuaaccagcaaagcagauucacaccagugggcguagcccagaaugagaacacucccuuccagcaguggguucuaccgcauuaugcaggggcccuggcucucaauaccaaccuggcgccugcaguggccccaacauuucccggagagcaacuucuguucuuuaggucgcgggucccuugcgugcagggcuugcguggucaggacgcuuucauugauugucuccugccccaggaaugggucaaucacuuuuaccaagaggccgcaccaucucaggccgacguggcuuuaauccgcuauguuaacccugauacugggagaacccuguucgaagccaagcuacacagguccggcuuuauaacagugucacauaccggaaacuacccccucguagucccaccgaauggccacuuccgguuugacaguugggugaaccaguucuauagccuggcaccuauggggacuggaaauggucgacgcagaguucaguga

SEQ ID NO: 20099 - RNA, 1629 nt, Artificial Sequence
  derived and/or modified sequence opt3 from VP1__Norovirus_and/or_Norovirus-like__AY113106
augaagauggccagcaacgacgcugcacccuccaaugauggcgccgcgucucuggugccugaggggaucaacgaaaccaugccacucgagccggucgcuggagccucaauugcagcccccguugcuggucagacaaauauaaucgacccuuggauuagaacuaacuucgugcaagcaccaaauggcgaauuuacgguaagucccaggaacagcccuggggagauccuucugaauuuggaauuaggaccagaucugaaccccuaccuagcccaccucucccggauguauaauggcuacgcuggugggguggagguccaggugcugcuugccggaaacgcguucaccgcaggcaaaauucuguuugccgcuaucccuccaaauuucccgguugacaugauaucucccgcccagaucacaauguugccucaucucauuguggauguccgcacucuggagccaaucaugauuccccugccugacgugcgaaacguauuuuaucacuucaauaaccagccacaaccccguaugagacucguugcaauguuauacaccccgcugaggucgaauggcucaggggaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgcuccaaacgagacaaauguugugcagugucagaacggaaggugcacucuugacggugaacugcaaggcaccacacaguugcucuccucagccguauguaguuaucgggggcgcaccguggcgaauaacggagauaauugggaccagaaccuguuacagcugacguacccgaauggcgccagcuacgaucccacugacgaggucccugcaccacucgguacacaagacuucucugggaugcuuuauggagugcugacccaggauaacguuaauguguccacuggcgaagcuaagaacgccaaaggcaucuacaucucaacaaccagcgggaaguuuacgcccaaggucggaaguauugguuugcauucuauaaccgagcacgugcauccuaaucagcaaucccgauucacaccaguaggcguugcugugaacgaaaauacucccuuccagcaguggguccuaccgcacuaugccgggagccuggcacucaacaccaaucuggccccugcuguggcgccaacauuucccggagagcagcuucuguucuuuagaucgagggucccuugcgugcaaggcuugcagggucaggacgcauucaucgauugucuccugccccaggaguggguuaaccacuuuuaccaagaagccgcuccaucucaggccgacguggcauuaauucgguauguaaacccugauacugggcguacccuguucgaggccaaacuacaucgcuccggcuuuaucacagucucacacaccggagcuuacccccucgugguuccaccgaauggccauuucagauuugacaguugggugaaccaguucuauagccuggccccuauggggacuggaaaugguaggcggcgaauacaguga

SEQ ID NO: 20100 - RNA, 1629 nt, Artificial Sequence
  derived and/or modified sequence opt3 from VP1__Norovirus_and/or_Norovirus-like__AB078334
augaagauggccagcaacgacgcugcacccuccaaugauggcgccgcgucucuggugccugaggggaucaacgaaaccaugccacucgagccggucgcuggagccucaauugcagcccccguugcuggucagacaaauauaaucgacccuuggauuagaacuaacuucgugcaagcaccaaauggcgaauuuacgguaagucccaggaacagcccuggggagauccuucugaauuuggaauuaggaccagaucugaaccccuaccuagcccaccucucccggauguauaauggcuacgcuggugggguggagguccaggugcugcuugccggaaacgcguucaccgcaggcaaaauucuguuugccgcuaucccuccaaauuucuugguugacaugauaucuccggcccagaucacaaugcucccccaucugauuguggauguccgcacucuggagccuaucaugaccccacuccccgacgugcgaaacguauuuuaucacuucaauaaccagccucaaccacguaugagauuaguugcaaugcuguacacaccccuuaggucgaauggcucaggggaugacguguuuaccgucagcugccggguguugacucgcccgacaccugauuucgaauuuauuuaucuggugcccccaagugucgaguccaagaccaaaccuuucacgcuacccauccucacuauaucugaacugaccaacagcagauuuccaauucccaucgagcagcuuuacacagcuccuaacgagacuaauguugugcagugucagaacggaaggugcacccuggacggugaauugcaaggcacaacccagcuccuguccucagccguauguuucuuacaggggcggacgguggcggauaauggagacaacugggaucagaaucugcuccaacuuacuuauccaaacggcgccaguuacgacccgacagacgagguccccgcaccucuggguacccaggauuuuagcgggauguuguacggagugcuaacucaggacaauguuaacgugucuacaggcgaagcuaagaaugccaaaggcauuuauaucuccaccacgucagggaaguucaccccaaagaucggaagcauuggucugcauaguauaacagagcacguccaucccaaccaacagucucgcuucacuccugugggcguagcuguugaugaaaauaccccauuucagcagugggugcucccccacuacgccgggucccuggcacuuaacacaaaucuggccccggcugucgcgccuacuuucccaggagagcaauugcucuuuuuccgaagcagagugcccugcguccagggccugcagggucaggacgcauuuaucgauuguuuacugccucaagagugggugaaccacuucuaucaggaagccgcucccucgcaggccgacguugcacuaauuagguacgugaauccagauaccgggcggacacucuuugaggccaaacugcaucguucuggcuucaucaccguaucccacacuggagcuuauccucuugucgugcccccaaacggccauuuucgcuucgacucauggguuaaccaguuuuacaguuuggccccgauggggacgggaaaugguagaaggcggauacaauga

SEQ ID NO: 20101 - RNA, 1629 nt, Artificial Sequence
  derived and/or modified sequence opt3 from VP1__Norovirus_and/or_Norovirus-like__KM289172
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaacggacaaucuuagugccgcgcagaucaccaugugcccgcaugugaucgucgaugugcggcaacuggagcccauuaacuugccuaugccagacguacgcaauaacuucuuucacuauaaccaggggagcgauucccgacuccgucugaucgccaugcuguacacaccccucagagcaaauaacucuggagacgauguuuucacugugucguguagggucuuaacccggccuucaccagacuuuagcuucaauuuucuggugcccccgacaguggaaaguaagaccaaaccuuucacucuucccauuuugacaaucuccgagaugucuaacagccgcuuuccagucccuauagauucccugcauaccucacccacggacaauauuguugugcagugccagaacgguagaguaacucuagauggcgaacucauggggaccacacaacugcuuccaagucagaucugugcuuucaggggagugcugacucggagcaccucucgcgccuccgaccaggcugacacagccacgccccgauuguucaauuauuacuggcacauucagcucgauaaccugaauggcaccccuuaugacccagcagaggauaucccggcccccuuagguacuccugacuuuagagggaaggucuucggaguggcuucacaaaggaacccagauagcacaacccgggcgcaugaggcaaaaguugacacuacaaguggccguuuuacccccaagcugggcucucucgaaaucuccacggagagcggggauuucgaccagaaucagccuacccgcuuuacaccagugggaauuggugucgauucggaagccgacuuccaacaguggacucuucccgauuacucuggccaguuuacccacaacaugaaucuggcuccggccguggcaccuaacuucccaggggagcaguugcuauuuuucagaucccaacugcccucaaguggaggcaggagcaaugguauacucgacugccugguaccucaggaauggguucagcacuuuuaccaggaguccgcccccgcucaaacacagguggcccuuguccgguaugugaacccagacacugggcgaguccuguucgaggcaaaguugcauaaacucggcuacaugaccaucgcgaagucuggagauagcccuauuacagugcccccaaacggcuauuuucgcuucgaaucauggguuaauccguucuacacccuggcuccuauggggacuggaaacuga

SEQ ID NO: 20102 - RNA, 1629 nt, Artificial Sequence
  derived and/or modified sequence opt3 from VP1__Norovirus_and/or_Norovirus-like__AY130762
augagaauggccagcuccgacgcucccgugucuggcaccgauggggcagccggacuggucccugagucacagcaagaaguucucccacuugagccgguggcggguguacagcuggcugcccccguggcaggccagaguaacaucauugacccuuggauaaggaugaauuucguccaggccccagcuggggaauuuacagugagcccccggaacgcaccuggagagguuuugaucgauuuagaacugggcccagagcuaaaucccuaccucaaccaccuggcccgcauguauaaugguuacgucgggggaauggagguggaagugguacuugcuggcaacgccuucacugcgggcaagauucuguuugcagccguuccuccauccuucccgacgcaugggaucucugcugcccaagcaaccauguugccccacgugauugucgacgugcgacagcucgagccugugcgucugccacugcccgaugucagaaauguuauguuucauuucugccaggaaaacaaagagccuaggaugcggaucguggcuauacucuauacaccauuacgcgccaauggagcgggugacgauguauuuacugugucguguagaguccugaccaggcccucaccggacuucgauuuuaucuuccuugugccucccagcguugagaguaaguugaaacaguuuacacugccaaaccuacaaccuaaugaaaugaccaacucccgguuccccacuggcauuacacagcucuacaccucuccaaauacgaaccuggugguccaguuucagaaugggcgcugccuucuggacggaacuuugcucggcaccacacccgugcgagccgcagauaucuguagcuucagagguguaacuuccaccgagguugacgcuacagauucaccuaggguggccgggagucaccggauuaugguccaacugaaggaaccagacggagaggaguucagcccgaccggccccaacccugcuccagugggcacgcccgacuuucaggccgcaaucuucgggacuuuaucucagcguaacacaggaggugccggccaaaauuccaaccgcgcucauuuugcguauuucuacaccagaaauccuacuuuugcaccagggauaggaacagucguguucucauuugauaccacggacuuccagaacaggcagcccaccaaauuuagcccgaguggcguuuucgaugacaauucuuccgaaccuuuuaaccaguucagccugccauauuacaaugguucgcucggggccguggaugcuggcaagcuggcacccccuguagcccccaacuacccaggagagcaaauucuuuauuuucggggcaauaucccuuucaagggaggguacggugaaggcgagauugacucuuugcuaccccaggaauggaucacacacuucuaugccgagcaggcuccaacucagggggaugccgcacugcuccgauacuauaacccggacaccggacgcguccuguuugaaugcaaacuucacagagagggcuucaucacaauuaauuacacugguuccaacgcgcuggcugugccuguuaaugggguguuuagguucgagggcugggucaacaaguuuuauaccuugacacccauguga

SEQ ID NO: 20103 - RNA, 1629 nt, Artificial Sequence
  derived and/or modified sequence opt3 from VP1__Norovirus_and/or_Norovirus-like__KJ196290
augagaauggccagcuccgacgcucccgugucuggcaccgauggggcagccggacuggucccugagucacagcaagaaguucucccacuugagccgguggcggguguacagcuggcugcccccguggcaggccagaguaacaucauugacccuuggauaaggaugaauuucguccaggccccagcuggggaauuuacagugagcccccggaacgcaccuggagagguuuugaucgauuuagaacugggcccagagcuaaaucccuaccucaaccaccuggcccgcauguauaaugguuacgucgggggaauggagguggaagugguacuugcuggcaacgccuucacugcgggcaagauucuguuugcagccguuccuccauccuucccgacgcaugggaucucugcugcccaagcaaccauguugccccacgugauugucgacgugcgacagcucgagccugugcgucugccacugcccgaugucagaaauguuauguuucauuucugccaggaaaacaaggagccuaggaugcggaucguggcuauacucuauacaccauuacgcgccaauggagcgggugacgauguauuuacugugucguguagaguccugaccaggcccucaccggacuucgauuuuaucuuccuugugccucccagcguugagaguaaguugaaacaguuuacacugccaaaccuacaaccuaaugaaaugaccaacucccgguuccccacuggcauuacacagcucuacaccucuccaaauacgaaccuggugguccaguuucagaaugggcgcugccuucuggacggaacuuugcucggcaccacacccgugcgagccgcagauaucuguagcuucagagguguaacuuccaccgagguugacgcuacagauucaccuaggguggccgggagucaccggauuaugguccaacugcgugaaccagacggagaggaguucagcccgaccggccccaacccugcuccagugggcacgcccgacuuucaggccgcaaucuucgggacuuuaucucagcgcaacacaggaggugccggccaaaauuccaacagagcucauuuugcguauuucuacaccaggaauccuacuuuugcaccagggauaggaacagucguguucucauuugauaccacggacuuccagaaccggcagcccaccaaguuuagcccgaguggcguuuucgaugacgauucuuccgaaccuuuuaaucaguucagccugccauauuacaacgguucgcucggggccguggacgcuggcaaacuugcacccccuguagcccccaauuacccaggagagcaaauucuguauuuucgaggcucugucccuuucaaagggggauacggugaaggcgagaucgauuccuugcuaccccaggaauggauuacacacuucuaugccgagcaggcuccaacucagggggacgccgcacugcuccgcuacuauaacccggauaccggaagagugcuguuugaaugcaaacuucacagggagggcuucaucacaaucaauuacacugguucaaacgcgcuggcuguuccugugaauggggucuuucgguucgagggcugggugaacaaguuuuauaccuugacacccauguga

SEQ ID NO: 20104 - RNA, 1629 nt, Artificial Sequence
  derived and/or modified sequence opt3 from VP1__Norovirus_and/or_Norovirus-like__GQ856474
augagaauggccagcuccgacgcucccgugucuggcaccgauggggcagccggacuggucccugagucacagcaagaaguucucccacuugagccgguggcggguguacagcuggcugcccccguggcaggccagaguaacaucauugacccuuggauaaggaugaauuucguccaggccccagcuggggaauuuacagugagcccccgggaugcaccuggagagguuuugaucgacuuagaacugggcccagagcuaaaccccuaccucaaucaccuggcccgcauguauaacgguuacgucgggggaauggagguggaagugguacuugcuggcaaugccuucacugcgggcaagauucuguuugcagccguuccuccauccuucccgacgcaugggaucucugcugcccaagcaaccauguugccccacgugauugucgaugugcgacagcucgagccugugcgucugccacugcccgacgucagaaacguuauguuucauuucugccaggaaaauaaagagccuaggaugcggaucguggcuauacucuauacaccauuacgcgccaacggagcgggugaugacguauuuacugugucguguagaguccugaccaggcccucaccggauuucgacuuuaucuuccuuguguugccuagcguugagaguaagcugaaacaguuuacacuacccaaucuccaaccaaacgaaaugaccaauucccgguucccuacuggcauuauccagcuguacacaucucccaacaccaaucuugugguccaguuucagaacgggcgcugccuguuggauggaacgcuccugggcacuaccccagugcgagccgcagacauuuguagcuucagagguguaacauccacugagguugaugcuaccgacucacccaggguggccgggagucaccggaucaugguccaauuaaaggaaccugacggagaggaguucagcccaacaggcccgaaucccgcuccugugggcaccccagauuuucaggccgcaauauucgggacgcugucucagcguaacacuggaggugccggccaaaacuccaaucgcgcuagauuugcguauuucuacacaaggaaccccaccuuugcaccugggauuggaacugucguguucucauuugacacaaccgauuuccagaaucggcagccaacgaaauuuagccccaguggcguuuucgacgaugacucuuccgaaccguuuaaccaguucagccucccuuauuacaaugguucgcuuggggccguggaugcuggcaagcuggccccacccguagcaccuaacuaccccggagagcaaaucuuguauuuucgaggcaauauuccauucaaagggggauacggugaaggcgagaucgacucucuacugccucaggaauggaucacccauuucuaugccgagcaggcucccacacagggggaugccgcacuccugcgcuacuauaacccagacacuggaagaguccuuuuugaaugcaagcugcacagggagggcuucauuaccauaaauuacacagguuccaacgcguuggcugugccgguuaaugggguguuucgguucgagggcugggucaacaaguuuuauacucucaccccuauguga

SEQ ID NO: 20105 - RNA, 1629 nt, Artificial Sequence
  derived and/or modified sequence opt3 from VP1__Norovirus_and/or_Norovirus-like__LC145787
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuuccccgugucuauagaucagauguacaccagcccaaacgaggucaucuccgugcagugucagaacgguagaugcacacuugacggcgaacugcaagggacuacccaguugcagguuucaggaauuugugccuuuaagggcgaggugacagcacaccuccaugauaaugaccaccuguauaacgucaccaucacgaauuuaaacgguagucccuucgacccuagcgaagaugugccagcuccgcuggggguacccgacuuccagggaaggguuuuuggcauuaucucucaacgggauaagcacaauuccccuggccauaacgagccagccaaucgcgggcacgacgcugugguccccacuuacacagcccaguacaccccuaaacucggacagauacaaauugguacuuggcagacagaugaccuuaccgugaaccagccagucaaguucacgcccgugggccugaaugauaccgaacauuuuaaccaguggguugugccgcgauaugcaggggccuugaaucuaaacacaaaucuggcuccuucaguagcgccagucuuccccggagagagacuccuguuuuucaggagcuacgugccucuuaaaggcgguuaugggaaccccgcaaucgacugccuguugccacaagaguggguucagcacuuuuaccaggaagccgcuccuaguaugucugagguggcccucguccgguauauuaaucccgauacuggccgugcacuguucgaagccaaguuacaccgcgcuggauuuaugaccguguccagcaacacaucggccccaguagugguuccggcaaacggcuacuucagauuugacucuugggucaaucaguucuauucccuggcgccuauggggacuggaaacgguaggcggcgagugcaauga

SEQ ID NO: 20106 - RNA, 1629 nt, Artificial Sequence
  derived and/or modified sequence opt3 from VP1__Norovirus_and/or_Norovirus-like__AB629946
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuucaccgugucuauagaucagauguacacaagccuuaacgaggucaucuccgugcagugucagaacgguagaugcacucuggacggcgaauugagggggaccacacaacuccagguuucaggaauuugugccuuuaagggcgaggugaccgcacacguccaugauaaugaccaccuguauaacgugacgaucacuaauuuaaacgguagucccuucgacccaagcgaagauguacccgcuccucuggggguuccagacuuccagggacggguguuuggcauuaucucucagcgcgauaagcacaauuccccgggccauaacgagcccgccaaucgagggcacgacgcugucgugccuacauacaccgcccaauacacuccaaaacucggacagauacagauugguacauggcaaaccgaugaccuuacggucaaccagcccgugaaguucaccccuguuggccugaaugauacagaacauuuuaaccagugggugguaccaagauaugcaggggccuugaaucuaaacacuaaucuggcucccucagucgcgccgguguucccuggagagaggcuccuguuuuuccggagcuacguuccacuuaaaggcgguuaugggaaccccgcaaucgacugccuguugccucaggagugggugcaacacuuuuaccaggaagccgcucccaguaugucugaggucgcccucgugcguuauauuaauccagauaccggccgcgcacuguucgaagccaaguuacacagagcuggauuuaugacaguauccagcaacacuucggccccugugguuguccccgcaaacggcuacuucagguuugacucuugggugaaucaguucuauucccuggcgccaauggggaccggaaacggucggcgacgcgugcaguga

SEQ ID NO: 20107 - RNA, 1629 nt, Artificial Sequence
  derived and/or modified sequence opt3 from VP1__Norovirus_and/or_Norovirus-like__KT962983
augaagauggccagcaacgacgcugcacccuccaccgauggcgccgcggggcuggugccugagucuaauacagaagucauggcucucgagccaguugccggagcagcccuugcugcaccggugacuggucagacgaacaucauugaccccuggauaagagccaauuucguacaagcuccuaacggcgaauuuaccgugucaccaaggaaugcccccggggagguccuguugaacuuagaacugggaccugagcuaaauccauaccucgcgcaccuggcacggauguauaacggcuacgccggugggauggaggugcagguuaugcuugcuggaaaugccuucacagcaggcaaacugguguuugcugccgugcccccucauuucccagucgaaaacuugaguccgcagcagaucacuauguuuccccacguaauuaucgauguucgcacccucgagccugugcugcugccacuccccgacguccgaaauaacuucuuucauuauaaucaaaaggaugacccuaaaaugcguauuguggcgauguuauacacaccacugagaagcaacggcuccggggaugacguguucaccgucucuugcaggguucuuacucggcccucgccggauuuugacuucacauauuuggugccucccaccguagaaucaaagacgaaaccauuuacucugccuauccuaacccucggagagcugagcaauagucgcuuccccguguccauagaucagauguacacaucuccaaacgaggucaucagcgugcagugucagaacgguagaugcacucuugacggcgaacugcaagggaccacacaguugcagguuuccggaauuugugccuuuaagggcgaggugaccgcacaccuccaugauaaugaccaccuguauaacaucacgauuacuaauuuaaacgguucacccuucgacccuagugaagauaucccagcuccgcuggggguccccgacuuccagggaaggguguuuggcauaauuagccaacgggauaagcacaauucuccuggccauaacgagccagccaaucgcgggcacgacgcuguaguucccacauacaccgcccaguacacuccuaaacucggacagauccaaauugguacauggcagaccgaugaccuuacggugaaccagccagucaaguucacccccgugggccugaaugauacagaacauuuuaaccagugggucgugccgcgauaugcaggggccuugaaucuaaacacuaaucuggcuccuuccguugcgccaguguuccccggagagagacuccuguuuuucaggucauacaucccucuuaaaggcgguuaugggaaccccgcaaucgacugccuguugccacaagaguggguacagcacuuuuaccaggaagccgcuccuagcaugagugaggucgcccucgugcgguauauuaaucccgauaccggccgugcacuguucgaagccaaguuacaccgcgcuggauuuaugacaguuucuuccaacacuagcgccccaguggucgugccggcaaacggcuacuucagauuugacucguggguaaaucaguucuauucucuggcgccuauggggaccggaaacgguaggcggcgagugcaauga

SEQ ID NO: 20108 - RNA, 1626 nt, Artificial Sequence
  derived and/or modified sequence opt3 from VP1__Norovirus_and/or_Norovirus-like__AB083780
augaagauggccagcaacgacgcugcacccuccaaugauggcgccgcggggcuggugccugagaucaacaccgaagucauggcucucgagccaguugccggaggugcaauugccgcuccgcuuacaggccagacuaauauaaucgaccccuggauuagaaacaauuucgugcaagcaccuaacggggaauuuacgaucucuccaaggaacucacccggagagauucuguugaauauggaauuaggcccugagcugaauccauuccuagcccaccucagucggauguacaacgguuuugcugggggaauggagguacaggugcugauggccggcaaugcguucaccgcaggcaaagucaucuuugccgcugugcccccucauuucccaguugaaaaccuuagcccgccccagauaacaauguuuccucacaucauuaucgaugugcgcacucuggagccagucuugcuccccaugccugacgugcgaaaucaguucuuucauuauaaccaaguaaaugaaccacguaugagacugguugccaugcuguacacaccccucagguccaacgggucuaccgaggauguguucaccgucucgugccggguguuaacucgcccgucaccugacuuugaguucaacuaucuggugcccccaacagucgaaagcagaaccaagccuuuuacgcuucccguuuugacuauuggagagaugaccaauaguagguucccagcacccaucgauaugcuguacacauccccuaacgguaaugugguagugcagccacagaacggccgguguacucuagacggggaacuccagggaucuacccaacuggucccggcuaaugugugcgccuuccgcggcaaaauaacagcgcgaauuguugaucaggccgcacaccaguggcauaugcagaucgacaaccccaaugguacccuuuuugauccuacggaggacgugccagcuccccuggggacuccugauuucaaggccaaaauuuuuggagucaucagccaaagaaacgacuauaaugacggcucccagggcccagcuaacagggcccacgaugcagugguacccacaaccucagccaaguucacuccgaaguuggggaguauccucguuggaacaugggaaaauaacgacauugagacccagccuagcaaauuuacgccagugggucuguuagagaugaaugauuucaaccaauggucucugcccaauuacuccggcgcucucacccuuaacauggggcuggcgccugcagucuuucccacauucccaggagaacagauauuguuuuuccggucauuuaucccucuaaagggcggucacgggaaccccgccauugacugucugcucccacaggaguggauccagcauuucuaucaagaaagcgcuccgagucagacuucuguggcccugauacguuacgucaauccugauaccggccgcgugcuuuuugagggaaaacugcacagacagggcuucauuacaaucgcaaaguccggggacggacccaucguugugccacccaacgguuacuucagguuugauagcuggguaaaucaguucuauucguuggccccuaugggcaacgggaauggacggcgacgcauucaauga

SEQ ID NO: 20109 - RNA, 1626 nt, Artificial Sequence
  derived and/or modified sequence opt3 from VP1__Norovirus_and/or_Norovirus-like__KX987840
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcauggcagaucugccugugauucagcccagacuuugcacgcaugcuagguggccagccccuguauacggccuguugguggaccccucccucccaucuaauccccaauggcagaacgggcggguccacguggauggaacucuguuaggcaccacaccuaucagcgguuccuggguuucauguuucgcugccgaagcagccuaugaguaccagagugggacuggagagguggcuaccuuuacacugauugaacaagacggcagcgcguacgucccaggcgaucgcgcagccccgcucggguaucccgacuucucuggacagcuugagaucgaagugcagaccgagacgacuaagccuggugacaaacugaagguaacaaccuuugaaaugauauugggcccaacuacaaauguugaucaggcucccuaccaagggcgaguguaugccuccgucaccgcagccgcuacgcuaaaccugguggacggaagagucagggccgugccucggucaauuuacggcuuccaggauguuaucccagaguauaaugacggucuccuggugccccuugcaccgccuauugggccauuccugcccggcgagguauugcuccguuuucgcaccuacaugagacagaucgauagcagugacgcggcugccgaagcaaucgauugcgcccugccucaggaguucauuucuugguuugcuuccaacgccuucacaguccaaagcgaagcauuacugcuaagguaucggaauacucucaccggacagcugcuuuuugaguguaaguuguacucggaaggcuacauagcucugucuuaucccggguccggaccacucacauucccuacugacggcuuuuucgaggugguuucaugggugccccgacuguaccagcuugccagugucgguagccuggcgaccgggcgcacauugaaacaguga

SEQ ID NO: 20110 - RNA, 1626 nt, Artificial Sequence
  derived and/or modified sequence opt3 from VP1__Norovirus_and/or_Norovirus-like__KR349276
augagaaugagcgacggcgccgcucccaaggcaaacggguccgaggccaauggacaggaucuggugccuaccgcggucgaacaagcuguuccaauccagccgguggccggugcaucucucgccgcucccgcagccggccagauuaaccagauagacccuuggaucuuccaaaauuuuguacagugcccacuuggggaguucucaauuagucccaggaacacaccuggagaaauccuguuugauuuggcuuuaggcccaggucugaaucccuaccuagcccaccucagcgcgauguauacugggugggugggaaacauggagguccagcuggugcuugcaggcaaugccuucacggcuggcaaaguuguggucgcccuggugccuccauacuuuccgaagggguccuugaccacagcacagauuacuuguuucccccauguaaugugcgacguucggacccucgaaccuauccaacugccacugcucgaugugcgccgagucuuauggcacgcuacacaggaccaggaggagucuaugcgucugguguguaugcuuuauacccccuugagaacuaacucgccuggagaugaaucauuuguggucagcgguaggcugcuaaguaaaccagccgcggacuucaauuuuguuuaccucacacccccgauagagcggaccaucuaucgcaugguggaucugccuguacuucagcccagacugugcacgcaugccagguggccagcaccuguguacggcuugcucgucgaccccucccuggggucuaacccacaauggcagaauggacgggugcacguugauggcacuuuacuggguaccacacccauuagcggguccugggugucacucuucgcugccgaagcugccuaugaguuucagaguggaacuggcgaggucgcaaccuucacacuuaucgaacaagacggcagcgccuacgugccuggggagcgcgcugcgccacugggauacccggauuuuucuggucaguuggaaauugagguacagaccgaaacgacuaagacaggcgacaaacuaaagguuaccacuuucgagaugauccuggggcccacaaccaacguggaccaggcaccuuaucaaggacgagucuacgccucccucacgaccgcugccucacuggaucuuguggacggcagagucagggcagugccacggagcauauaugguuuccaggauguuauucccgaguacaaugacgggcuguuggugccucucgccccacccaucggcccguuucugccuggagaaguauuacugcguuuccgcacauauaugagacagauugauaguucugacgcugccgcagaggcgaucgauugugcucuaccacaggaauuugucuccugguucgccagcaacgcauuuacugugcaaucggaggcccuccugcuuagguaccggaauaccuugacaggccagcuccuguucgaaugcaagcuguauucugagggguacaucgcucuuuccuacucaggaagugguccccugacuuuuccuaccgacggcuucuuugagguugugagcugggggccccgauuguaucagcucgccuccgucggaucucuggcaacaggccgcaccuuaaaacaguga

SEQ ID NO: 20111 - RNA, 1626 nt, Artificial Sequence
  derived and/or modified sequence opt3 from VP1__Norovirus_and/or_Norovirus-like__KM102449
augagaaugagcgacggcgccgcucccaaggcaaacggguccgaggccaucggacaggaucuggugccuaccgcggucgaacaagcuguuccaauucagccgguggccggugcagcccucgcugcacccgccgcuggccagauaaaucagaucgacccuuggauuuuccaaaacuuuguacagugcccacuuggggaguucucuaucucacccaggaauacaccuggagaaauucuguuugauuuggccuuaggcccaggucugaaccccuaccuagcgcaccucagugcaauguauacugggugggugggaaauauggagguccagcuggugcuugccggcaacgcuuucacggccggcaaaguuguggucgcacuggugccuccauacuuuccgaaggggagcuugaccacagcucagaucacuuguuucccccauguaaugugcgacguucgggcccucgaaccuauacaacugccacugcucgaugugcgccgagucuuauggcacgcgacccaggaccaggaggaguccaugcgucugguguguaugcuuuauacacccuugagaaccaauucuccuggagaugaaucguuuguggucucagguaggcugcuaagcaaaccagccgcagacuucaacuuuguuuaccucacucccccgaucgagcggacaguguaucgcaugguagaucugccugugcuucagcccagacugugcacccaugcuagguggccagccccugucuacggcuugcucguggaccccagucugccauccaauccccaauggcagaacgggcggguucacgugaauggaacguuacugggcacuaccccugucucugguagcuggguguccuguuucgcugccgaagcagccuaugaguuucagucagggacaggagagguagcuacuuucaccaugauugaacaagauggcagugcguacguuccaggcgaccgcgcagccccgcucggguaccccgauuuuagcggacagcuugagaucgaagugcagacagagaccacgaagucuggugacaaacugaaggucacuacauucgaaaugauuuugggcccuaccacuaacgcugaccaggccccauaucaagggaagguguacgcaucccuagccgcugccgcaccccuggaucucgucgacggacgagugagagcgguuccuaggucaguguauuucuuucaggauguacugccagaguacaaugacggccuucugguccccuuggcuccgccucucgguccauuccugcccggggagguguuacugcgguuucguacauauguucgccagcuagauaccgccgacgcagccgcucagccuaucgauugcgcccucccccaagaguucauaagcugguuugcaaguaacucuuucacggugcaguccgaagcucugcuuauuagauacaggaauaccuugacaggccagcugcucuuugaagccaaacuguauagcgagggauacaucgcggucucguacucuggcuccgggccacuuacuuucccuaccgacggauuuuucgaagugguaucaugggugccccggcuguuucaguuggccaguguugguagccucgcuacaggccgaacucugaagcaauga

SEQ ID NO: 20112 - RNA, 1626 nt, Artificial Sequence
  derived and/or modified sequence opt3 from VP1__Norovirus_and/or_Norovirus-like__KC792553
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguacuucagcccagacugugcacgcaugcaagguggccagcuccuguguacggcuugcucgucgaccccucccugccaucuaauccccaauggcagaacgggcgggugcacguugauggaacuuuacugggcaccacaccugugagcgguuccugggucucauguuucgccgcugaagccgcauaugaguuucagagugggauuggacaaguggccacuuucaccaugaucgagcaggacggcagcgcuuacguaccaggcgaucgcgcggcaccgcucggguaccccgacuauucuggacagcuugaaauugagguucagacagaaaccacgaaggccggugacaaacugaaggugacuacauuugagaugaucuugggcccuaccacuaaugcugaucaagccccauaccaggggcgagcauaugccucccuaacagcugccgcaucacuggaccucgucgauggaagagugagggcggucccccggagcauauacaguuuccaggacgugcugccugaauauaacgauggccuucugguuccauuggcucccccgcucgguccuuuccugccaggggagguguuacugcguuuucgcaccuacaugagacagcuagacacggccgaugcagccgcucaacccauugacugcgcccucccucaggaguucguaucuugguuugcauccaauagcuucaccguccagucggaugcucugcuugugagguaucggaacacauugacuggccagcugcucuuugaagccaagcuguacucugagggauacaucgcgguuuccuauucaggcagugggccccuuaccuucccagccgacggaauuuuugaaguggucagcugggugccucgacuguuccaauuggcuuccguagguucucucgcaacaggccgcacucugaaacaguga

SEQ ID NO: 20113 - RNA, 1626 nt, Artificial Sequence
  derived and/or modified sequence opt3 from VP1__Norovirus_and/or_Norovirus-like__AB809991
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcagggucaggacgcuuucauugauugucuccugccccaagaaugggucaaucacuuuuaccaggaggccgcaccaucccaggccgacguggcuuuaauccgguauguuaacccugauacagggcguacucuguucgaagccaaacuacaccgcucaggcuuuauaaccgugagucauacaggagcauacccccucguagucccaccgaacggccacuucagauuugacagcugggugaaucaguucuauucccuggcgccuauggggaccggaaacgguaggcggcgaguuuga

SEQ ID NO: 20114 - RNA, 1626 nt, Artificial Sequence
  derived and/or modified sequence opt3 from VP1__Norovirus_and/or_Norovirus-like__AB809990
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcggggucaggacgcuuucauugauugucuccugccccaggaaugggucaaucacuuuuaccaagaggccgcaccaucccaggccgacguggcuuuaauccguuauguuaacccugauacagggcgcacucuguucgaagccaaacuacacagaucaggcuuuauaaccgugagucauacaggagcauacccccucguagucccaccgaacggccacuucagguuugacagcugggugaaucaguucuauucccuggcgccuauggggaccggaaacggucggcgacgcguuuga

SEQ ID NO: 20115 - RNA, 1626 nt, Artificial Sequence
  derived and/or modified sequence opt3 from VP1__Norovirus_and/or_Norovirus-like__AB809977
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaacgaaccggagaggccaagaacgcuaaaggcaucuacauuaguacuacaucuggcaaguuuacccccaagauaggguccaucggauugcauagcauuacggaaaaugugcacccuaaccagcaaucgagauucaccccagucgguguggcccagaaugagaacacacccuuccagcaguggguacuaccgcauuaugcaggcgcccuggcucucaauacuaaccuggcgccugcaguugccccaaccuuucccggggagcaacuucuguucuuuaggucucgggugccuugcguccagggauugcagggccaggacgcuuucaucgauugucuccugccccaagaaugggugaaucacuuuuaccaggaggccgcaccaucccaggccgacgucgcuuuaauacguuaugugaacccugauacaggucgcacucuguucgaagccaaacuacacagaucaggguuuauuaccguuagucauacaggcgcauacccccucgugguaccaccgaacggacacuucagguuugacagcugggucaaucaguucuauucccuggcgccuaugggcaccgggaacggacggcgacgcguguga

SEQ ID NO: 20116 - RNA, 1626 nt, Artificial Sequence
  derived and/or modified sequence opt3 from VP1__Norovirus_and/or_Norovirus-like__AB809987
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugauccaggauaauguuagcgaaggaacaggcgaggccaagaacgcuaaaggcguguacauuaguaccacuucugggaaguuuacacccaagauaggauccaucgguuugcauagcauuaccgaaaauguccacccuaaccagcaaucgcgauucacgccagugggcguagcccagaaugagaacacccccuuccagcaguggguucuaccgcauuaugcaggggcccuggcucucaauacaaaccuggcgccugcaguggccccaacuuuucccggagagcaacuucuguucuuuagaucuagggucccuugcgugcagggcuugcggggucaggacgcuuucaucgauugucuccugccccaggaaugggucaaucacuuuuaccaagaggccgcaccaucccaggccgacguggcuuuaauacguuauguuaacccugauaccgggcgcacacuguucgaagccaaacuacacagaucaggcuuuauuacugugagucauaccggagcauacccccucguagucccaccgaacggccacuucagguuugacagcugggugaaucaguucuauucccuggcgccuauggggacaggaaacggucggcgacgcguuuga

SEQ ID NO: 20117 - RNA, 1626 nt, Artificial Sequence
  derived and/or modified sequence opt3 from VP1__Norovirus_and/or_Norovirus-like__AJ844469
augaugauggccagcaaggacgcucccuccaacauggauggcaccucuggggcaggacagcuggugccugaggccaauacagcggacccaaucccgcucgaacccgucguuggugcugccacugcagccgcuacggcaggccaagugaacaugauugauccuuggauaaugaauaacuucguacagucaccagagggggaauuuaccaucagucccaauaacacaccuggagacauucuuuucgaucugcaguugggcccacacuuaaaucccuuucugcagcaucuaagccaaauguacaacgguuggguggggaauaugagagucaggauccuccuggccggaaacgcuuucuccgccggcaaaauuaucauaugcugugugccuccaggcuuuacugcgcagaauaucucuauugcacaggccaccauguucccgcacguuaucgcugacgugcggguccuugagcccauugaaaucccucuggaugacgugcgcaacguauuguuucauacaaaugagaacaagccaaccaugcgacuccugugcaugcuguauacuccccuccgugccgggggagcaucggcugguacagauccuuucguuauagccggcagaguguuaaccuguccaucacccgacuuuaauuuccuguuucuugucccgccuagcguggagcagaaaacgaggcaauugacugugcccaacauuccacugaacaaucuaaguaacucccgggucccugcgaugaucucuaagauggccauuagcuccgaugcaaaucagguugugcaguuccagaacgggcgcugcaccacagacggacaacuccugggcacuacccccaucucagcuagucagguagccagaaucagggguaaaguguuuagcacaucuuccgggaagggacuuaaucugucagaauuggauggcagcccauaccacgcuuucgagagucccgccccugucggcuucccagaccucggguauugugacuggcaugugucuuccuuuaaggcagaucacaacagcucgucugacccgauuucccggcuggauauaaaacagggagccucauucgcuccccacuuagguaguaucgaauacaccacgagccaaaauccugacggcgaucagcuggggacucucacauggauuuccucuccaagcgacgauacccccggacauggcacuaucaaccuuuggaagauaccuucauaugguaguacaguuaccgaguccgugcaccuggcgccacccauuuacccgccuggguuuggcgagacguuggucuauuucaugagcgacuuuccaaucggacauaccaauucuaacauggcacaggugcccugcacacuaccucaggaguucguagcccacuuuguuaaugaacaagcucccgugcgcggcgaugccgcacugcuccacuacgucgacccagauacucaucgaaaccugggggaguucaaacuuuacccugaaggauauaucaccugugugcccaauacagguggcgggggaccacagucacugccgauuaacggcgucuuuaucuucaguagcuggguguccagauacuaucaguugaagccuguugguacugccgggcccgcuaggcggcucuga

SEQ ID NO: 20118 - RNA, 1626 nt, Artificial Sequence
  derived and/or modified sequence opt3 from VP1__Norovirus_and/or_Norovirus-like__AY675555
augaagauggccagcaaagacgcucccuccaacauggauggcaccucuggggcaggacagcuggugccugaggccaauacagcggacccaauuccgcucgaacccgucguuggugcugccacugcagccgcuacggcaggccaagugaacaugauugauccuuggauaaugaauaacuucguacagucaccagagggggaauuuaccaucagucccaauaacacaccuggagacauucuuuucgaucugcaguugggcccacacuuaaaucccuuucugcagcaucuaagccaaauguacaacgguuggguggggaauaugagagucaggauccuccuggccggaaacgcuuucuccgccggcaagauuaucauaugcugugugccuccaggcuuuacugcgcagaauaucucuauugcacaggccaccauguucccgcacguuaucgcugacgugcggguccuugagcccauugaaaucccucuggaugacgugcgcaacguauuguuucauacaaaugagaaccgaccaaccaugcgucuccugugcaugcuguauacuccccucagagccgggggagcaucggcugguacagauccuuucguuauagccggcaggguguuaaccuguccaucacccgacuuuaauuuccuguuucuugucccgccuagcguggagcagaaaacgcggcaauugacugugcccaacauuccacugaacaaucuaaguaacuccucugucccugcgaugaucaauaagauggccauuagcuccgaugcaaaccagguugugcaguuccagaaugggcgcugcaccacagacggacaacuccugggcacuacccccaucucagcuagucagguagccagaaucagggguaaaguguuuagcacaucuuccgggaagggacuuaaccugucagaauuggauggcagcccauaccacgcuuucgagagucccgccccugucggcuucccagaccucgggcauugugacuggcacgugucuuccuuuaaggcagaucagaauagcucgggagacccgauuucucggcuggauauaaaacaaggugccuccuucgcuccccacuuaggcucaaucgaauauaccacgagucagaacccugacgggggacagcugggcacucucacauggauuagcuccccaucugaugacacccccggucaugggacuaucaaucuuuggaagauaccuagcuacggcucaacaguuaccgagagugugcaccuggcgccacccauuuauccgccuggauuuggcgagacguuggucaaccuaauguccaauuucccaaucgggcauaccaacagcaauauggcacaggugcccugcacacugccucaagaauuuguagcccacuucguuaacgagcaggcucccgugcgcggagaugccgcacuccugcacuacgucgacccagauacucaucgaaaucuuggugaauuuaaacuguauccugagggcuacaucaccugugugcccaacacagggggaggcgguccacagucuuugccgacuaacggggucuucaucuuuucaaguugggugagcagauacuaucagcucgaaccuguuggcaccgccggacccgcuaggcggcuguga

SEQ ID NO: 20119 - RNA, 1626 nt, Artificial Sequence
  derived and/or modified sequence opt3 from VP1__Norovirus_and/or_Norovirus-like__EU085479
augaagauggccagcuccgacgcuacccccucuaacgauggcgcagccgggcuggugccugagaucaauaacgaagcgauggcucucgacccagucgccggagcagccauugcugcaccgcuuacaggucagcaaaauauaaucgaucccuggauuaugaacaauuucguucaggccccuggcggggaguuuacugugucaccaagaaacagucccggagaaguacuguugaauuuagagcugggcccugaaaucaacccauaccuagcucaccucgccaggauguauaaugguuacgcagggggauucgaggugcaggucgugcuggcgggcaacgccuuuacggcuggcaaaauuaucuucgccgcaauacccccuaauuuuccaaucgacaaccuuagcgcugcccagauuaccaugugcccgcauguuaucguggauguccggcaacuggagcccgugaauuugccuaugccagacguacgcaacaauuucuuucacuauaaccagggguccgauucucgacuccgucugauugcgaugcuguacacaccccucagagccaacaauucgggagacgauguuuucacugugucauguagggucuuaacccggccuagcccagacuuuaguuucaacuuucuggugcccccgacaguggaauccaagaccaaaccuuucacucuucccaucuugacaauaucugagaugagcaauucccgcuuuccagucccuauugauucacugcauaccagucccacggaaaacaucguugugcagugccagaaugguagaguaacucuagacggcgagcucauggggaccacacaacugcuuccaagccagauuugugcauucaggggagugcugacucggucuaccucccgcacaucagaucaggcugacaccgccacgccccgauuguucaacuauuacuggcacauccagcucgacaaucugaacggcacuccuuaugauccagcugaggacaucccgggucccuuagggacaccugauuuuagaggaaaggucuucggcguggccagccaaaggaauccagacaguaccacucgggcacaugaagccaaaguugauacaaccgcuggccguuuuacgcccaagcuggggucucucgagauuuccaccgaaagcucggacuucgaucagaaccagccuacacgcuuuacuccagugggaauaggugucgaccacgagaccgauuuccaacaguggucucuucccgacuacuccggccaguuuacacacaauaugaaccuggcgccggcaguggccccuaauuucccaggggaacaguugcuauuuuucagaucacaacugcccaguagcggaggcagguccaacgguauccucgauugccugguaccucaggaguggguucagcauuuuuaccaggagucugcucccgcccaaacucagguggcacuuguccgguaugugaauccagacaccgggcgaguccuguucgaagccaaguugcacaaacucggcuuuaugacaauugcuaagaacggagacagcccuaucaccgugcccccaaacggcuacuuccgcuucgagucauggguuaauccguuuuauacucuggccccuauggggaguggauga

SEQ ID NO: 20120 - RNA, 1626 nt, Artificial Sequence
  derived and/or modified sequence opt3 from VP1__Norovirus_and/or_Norovirus-like__AF542090
auggccagcaaggacgcucccguguccggcaccgauggggcagccggacuggucccugagucucagcaagaaguucucccacuugagccgguggcggguguacagcuggcugcccccguggcaggccagucaaacaucauugacccuuggauaagaaugaauuucguccaggccccagcuggggaauuuacagugagucccaggaacgcaccuggagagguuuugaucgauuuagaacugggcccagagcuaaaucccuaccucaaccaccuggcccggauguauaaugguuacgucgggggaauggagguggaagugguacuugcuggcaacgccuucacugcgggcaaaguucuguuugcagccgugccuccgagcuucccaacgcaugggauuaccgcugcccaagcaacaauguugccccacgucaucguggacgugcgccagcucgagccuguccgacugccacugcccgauguucguaaugugauguuucauuucugccaggaaaacaaggagccuagaaugaggauuguagcuauccucuauacuccauuacgggccaauggagcgggugacgauguguuuaccgucuccugucgcgugcugacaagacccucuccggacuucgauuuuauauuccuuguuccucccucgguggagucaaaauugaagcaguuuacccugccaaaccuacaaccuaaugaaaugacuaacagcagguuccccacaagugucacccagcucuacacguccccaaauacuaaccuggugguacaguuucagaauggccggugccaacuugacgggacccuguugggaacaacucccguucgcgccgcagauaucuguucuuuccgaggcauuaccagcgcugagguggacacaaccgauuccucaagagucgccgguagucacagggugaugguccagcucaaagaaccugacggggaggaguucagcccaacgggaccgaaccccgcuccugugggcacuccagacuuucaggccgcaaucuucggcacacugucucaacggaacaauaccgggggauccggucagaacucaaaucguagccauuuugccuauuucuacacucgcaaccccacauuugcuccuggcauugggaccguuguguucaguuuugauacgaccgacuuccagaauagacagccaacaaaguuuucucccuccggaguauaugaugacgauagcucggaaccguucaaccaauuuucuuuaccuuacuacaauggcucccugggugcggucgacgcagggaagcucgccccacccguggcuccuaacuaucccggcgagcagauccuuuacuucaggggaaauauaccauuuaaaggcggguauggagguggcgaaauugauugccuguugccucaggaguggaucacucaccuauacgccgaacaggcacccacccaaggggacgccgcucugcuccgguauuacaacccagauacaggacgaguucuguucgaguguaaacuucaccgcgaaggcuucauuacuaucaauuauaccgguucaaacgcccuggcagugccggucaaugggguguuuagauucgagggcuggguaaacaaguuuuacacauugaccccuauguga

SEQ ID NO: 20121 - RNA, 1623 nt, Artificial Sequence
  derived and/or modified sequence opt3 from VP1__Norovirus_and/or_Norovirus-like__KM386680
augaagauggccagcaacgacgcuacccccuccaaugauggcgcagccgggcuggugccugagucuaacaaugaagcgauggcucucgagccagucguuggagccucacuugcagccccggugacaggucagacuaacaucauugaccccuggauaagaacgaauuucguacaagcuccuaacggcgaauuuaccgugaguccaaggaauagccccggggagauccuggucaacuuggaauuaggaccugagcugaauccauaccuagcacaccucgcccggauguauaacggcuacgcuggugggauggaggugcagguuaugcuggccggaaaugcguucacagcaggcaaaauuaucuuugccgcugugcccccuuauuucccagucgaaaaccuuuccccgccccagauuacuauguuuccucaugugaucauagauguacgcacccuggagccaguuuugcuccccaugccugacgugcgaucuacacuguuccacuuuaaucagaaggaugaaccaaaaaugcgucuggucgccaugcucuacacccccuuaagaucgaacggcucaggggacgauguguucacugugagcugcaggauccugacacggccgaguccugaguuugacuucaccuaucuuguucccccaacggucgaguccaagacuaaaccuuuuaccuugcccgugcugacacuaggagaacucucuaauagccgcuucccacuguccauugaugagaugguaacuucacccaacgaaaguaucgugguccaaccucagaacgguagagugacccuugacggcgagcuguuggggacaacccagcuccaggcauguaauauuugcagcaucaggggaaagguuacgggccaagugccaaacgaacagcauauguggaaucuggagauaacuaacuuaaaugguacacaguuugauccgaccgacgauguccccgcuccucugggggugccagacuucgccggagagguauucggcguucucucucagcggaaccgcggcgaauccaaucccgcgaaccgagcccacgacgcaguggucgcuacuuacucagauaaguauacaccuaaacuugggcuggugcaaauuggaaccuggaauacgaacgacgucgagaaucagccaaccaaguuuacacccaucgguuugaacgaaguggccaauggccauagauucgagcaguggacucuaccgagguacagcggggcucugacccucaacaugaaucuggccccugcaguugccccacuuuuucccggagaacggcuguuguucuuucguaguuacgugccucucaaaggcgguuucgggaaccccgcuauugauugucugguaccacaagaguggguccagcacuuuuaucaggagucugcgccuuccuuaggcgacguggcacugguucgcuacgugaaccccgauacaggaagaguccuauucgaagccaagcuccacaaaggcggguuucugacugugagcucgaccucuacaggaccaguagugguuccggcuaaugguuauuucagguuugacuccugggucaaccaguucuacucacuugccccuaugggcaccgggaauggacggcgacgcuuucaauga

SEQ ID NO: 20122 - RNA, 1623 nt, Artificial Sequence
  derived and/or modified sequence opt3 from VP1__Norovirus_and/or_Norovirus-like__AF397156
augaagauggccagcaacgacgcuacccccuccaaugauggcgcagccgggcuggugccugagucuaacaaugaagcgauggcucucgagccagucguuggagccucacuugcagccccggugacaggucagacuaacaucauugaccccuggauaagaacgaauuucguacaagcuccuaacggcgaauuuaccgugaguccaaggaauagccccggggagauccuggucaacuuggaauuaggaccugagcugaauccauaccuagcacaccucgcccggauguauaacggcuacgcuggugggauggaggugcagguuaugcuggccggaaaugcguucacagcaggcaaaauuaucuuugccgcugugcccccuuauuucccagucgaaaaccuuuccccgucucagauuacuauguuuccccaugugaucauagauguacgcacccuggagccuguuuugcucccaaugcccgacgugcgaucgacacuguuccacuuuaaucagaaggaugaaccuaaaaugcgucuggucgccaugcucuacaccccauuaagaucaaacggcagcggggacgauguguucacugugaguugcaggauccugacacggcccuccccggaguuugacuucaccuaucuugucccucccacgguugagucuaagacuaaaccauuuaccuugccugugcugacacuaggagaacucagcaauucccgcuucccccugucaauugaugagaugguaacuagcccaaacgaaagcaucgugguccaaccccagaacgguagagugacccuugacggcgagcuguuggggacaacccagcuccaggcauguaauauuugcucuaucaggggaaagguuacgggccaagugccuaacgaacagcauauguggaaucuggagauaacuaacuuaaaugguacacaguuugauccaaccgacgaugucccggcuccccugggggugccugacuucgccggagagguauucggcguucucucccagcggaaccgcggcgaaucaaauccagcgaaccgagcccacgacgcaguggucgcuacuuacagcgauaaguauacacccaaacuugggcuggugcaaauuggaaccuggaauacgaacgacgucgagaaucagccuaccaaguuuacaccaaucgguuugaacgaaguggccaauggccauagauucgagcaguggacucuacccagguacaguggggcucugacccucaacaugaaucuggccccggcaguugccccucuuuuuccaggagaacggcuguuguucuuucguucuuacgugccccucaaaggcgguuucgggaacccugcuauugauugucugguaccccaagaguggguccagcacuuuuaucaggaguccgcgccaaguuuaggcgacguggcacugguucgcuacgugaacccugauacaggaagaguccuauucgaagccaagcuccacaaaggcggguuucugacugugucgucuaccuccacaggacccguagugguuccagcuaaugguuauuucagguuugacccguggggcaaccaguucuacucacuugccccuauggggaccggaaauggccggcgacgcuuucaauga

SEQ ID NO: 20123 - RNA, 1623 nt, Artificial Sequence
  derived and/or modified sequence opt3 from VP1__Norovirus_and/or_Norovirus-like__AF414422
augaagauggccagcaacgacgcuacccccuccaaugauggcgcagccgggcuggugccugagucuaacaaugaagcgauggcucucgagccagucguuggagccucacuugcagccccggugacaggucagacuaacaucauugaccccuggauaagaacgaauuucguacaagcuccuaacggcgaauuuaccgugaguccaaggaauagccccggggagauccuggucaacuuggaauuaggaccugagcugaauccauaccuagcacaccucgcccggauguauaacggcuacgcuggugggauggaggugcagguuaugcuggccggaaaugcguucacagcaggcaaaauuaucuuugccgcugugcccccuuauuucccagucgaaaaccuuuccccgucucagauuacuauguuuccccaugugaucauagauguacgcacccuggagccuguuuugcucccaaugcccgacgugcgaucgacacuguuccacuuuaaucagaaggaugaaccuaaaaugcgucuggucgccaugcucuacaccccauuaagaucaaacggcagcggggacgauguguucacugugaguugcaggauccugacacggcccuccccggaguuugacuucaccuaucuugucccucccacgguugagucuaagacuaaaccauuuaccuugccugugcugacacuaggagaacucagcaauucccgcuucccccugucaauugaugagaugguaaccaguccaaacgaaagcaucgugguccaaccccagaacgguagagugacucuugacggcgagcuguuggggacaacccagccucaggcauguaauauuugcucuaucaggggaaagguuacgggccaagugccaaacgaacagcauacuuggaaucucgagauaacaaaccugaaugguacccaguuugauccgacugacgauguccccgcuccuuuaggggugccagacuucgccggagagguauucggcguucugucccagcggaaccgcggcgaaucaaaucccgcgaaccgagcccacgacgcaguggucgcuacauacagcgauaaguauaccccuaaacucgggcuugugcaaauuggaacguggaauaccaacgacgucgagaaucagccaacaaaguuuacucccaucggucugaacgaaguggccaauggccauagauucgagcaguggaccuugccgagguacaguggggcucuaacacugaacaugaaucucgccccugcaguugccccacuguuucccggagaacggcuucuguucuuucguucuuacgugccuuugaaaggcgguuucgggaaccccgcuauugauugucucguaccacaagaguggguccagcacuuuuaucaggaguccgcgccuagccugggcgacguggcauuaguucgcuacgugaaccccgauacuggaagaguccuguucgaagccaagcuacacaaaggcggguuucucaccgugucgucuacauccaccggaccaguagugguuccggcuaaugguuauuucggcuuugacucaugggucaaccaguucuacagucuggccccuauggggacuggaaauggcaggcggcgauuucaauga

SEQ ID NO: 20124 - RNA, 1623 nt, Artificial Sequence
  derived and/or modified sequence opt3 from VP1__Norovirus_and/or_Norovirus-like__AF414423
augaagauggccagcaacgacgcuacccccuccaaugauggcgcagccgggcuggugccugagucuaacaaugaagcgauggcucucgagccagucguuggagccucacuugcagccccggugacaggucagacuaacaucauugaccccuggauaagaacgaauuucguacaagcuccuaacggcgaauuuaccgugaguccaaggaauagccccggggagauccuggucaacuuggaauccggaccugaguuaaauccauaccuggcacaccuagcccggauguauaacggcuacgcuggugggauggaggugcagguuaugcucgccggaaaugcguucacagcaggcaaaauuaucuuugccgcugugcccccuuauuucccagucgaaaaccugucuccgucgcagauuacuauguuuccccaugugaucauagauguacgcacccuugagccuguucuguugccaaugcccgacgugcgaucaacaccuuuccacuuuaaucagaaggaugaaccaaaaaugcgucucgucgccaugcuguacacuccccugagaagcaacggcaguggggacgauguguucaccguguccugcaggauccucacacggccgucuccugaguuugacuucaccuauuuaguucccccaacggucgagagcaagacuaaaccuuuuacccugcccgugcuuacauugggagaacuguccaauucacgcuucccacuaaguauugaugagaugguaacuagccccaacgaaucuaucgugguccaaccucagaacgguagagugacccucgacggcgggcugcuuggaacaacccagcugcaggcauguaauauuugcuccaucaggggcaagguuacgggucaagugccaucagagcagcauauguggaacuuggaaauaacuaaucucaacgggacacaguuugauccgaccgacgauguccccgcuccucugggagugccagacuucgccggcgagguauucggcguuuuaagccagcggaaucgcggggagaguaacucugcgaaucgagcccacgacgcaguggucgcuacuuacuccgauaaguauacacccaaacugggacucgugcaaauugguaccuggaacacgaaugacgucgaaaaccagccuaccaaguuuacaccaaucggccuuaaugggguggccaacggacauagauucgagcaguggacucugcccagguacagcggcgcuuugacccuaaauaugaaccuggccccggcaguugccccucucuuuccaggugaacggcugcuuuucuuucguucguacgugccccugaaagggggcuucggaaauccugcuauugauuguuugguaccccaagaguggguccagcacuuuuaucaggaaucugcgccaucccucggcgacguggcacugguucgcuacgugaacccugauacagggagagucuuauucgaggccaagcugcacaaaggagguuuucuaacugugucaaguaccagcacaggccccguagugguuccagcuaacggguauuucagguuugacuccugggucaaucaguucuacucucucgccccgaugggaaccggcaacggucggcgacgcuuucaauga

SEQ ID NO: 20125 - RNA, 1623 nt, Artificial Sequence
  derived and/or modified sequence opt3 from VP1__Norovirus_and/or_Norovirus-like__GQ856476
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggagaucuuguuaaaucuggaacuaggaccugagcucaacccauaccuggcccaccuuagccggauguauaauggcuacgcugguggggucgaggugcagguucuguuggccggaaacgcguucacggcaggcaaacucguguuugccgcuauucccccucauuucccagucgauaaucuguccccgggccagaucaccauguuuccccacgugauuaucgacguacgcacacuggaaccuguucucuuaccacugcccgaugugcgaaacaauuucuuucauuauaaccagcaaucugaccagcguaugagacuugucgccauguuguacacuccucugaggucgaacgggucaggagaugacguguucaccgugagcugccggguccuaacacgcccaagucccgauuuugacuucaauuaucucguuccgccuaccguggaguccaagacuaaacccuuuucuguaccagugcugacacuuaacgaacugaccaauagcagauucccuguccccauagaugcaauguacacguccccaaacgacucaaucgugguucagccccagaaugguagggcuacuauugauggcgaguugcucgggaccacacaacugaucccuaguggaauuuguagcuuucggggcaagaucacuacccacuuagccgacgaccgccaucuguggaacauacaggugucuaaucucaacgguacaccauucgauccgaccgacgauguccccgcgccucuugggaugccagacuucuccggacagauuuuuggcgugguaucacagcgagauacgggcacuaaucccgccaacagagcacacgacgcuguucuggccacauauagcgcuaaauacaccccuaaguuggggagugugcaaaucggaacuugggauacagaggaccuacuggaaaggcagccagucaaguucacccccgugggucucaaugagauuggccaggauaaacacuuugaccaauggguccugccgaacuacucuggggcccuuggacugaauaugcauuuggccccugcaguguccccacucuuccccggcgaacggcuguuauuuuuccguagcuauaucccucugaagggugggcacggcgaucccuuuaucgacugccuaguuccacaggaguggauucagcauuucuaccaggaaucggcuccugcgcaaucuuccguggcacuccugcgcuauguaaaccccgacacgggaagaacccuuuuugaggccaaauugcacaagggcggguucauaacagucucaaguacugagaauaggccagugaucguuccgccuaacggauacuuucgguucgauagcugggugaaccaguuuuauucccuggcucccauggguaccggcaaugggcgacgcagaaugcaguga

SEQ ID NO: 20126 - RNA, 1623 nt, Artificial Sequence
  derived and/or modified sequence opt3 from VP1__Norovirus_and/or_Norovirus-like__AJ277607
augaagauggccagcaacgacgcuacccccuccaaugauggcgcagccgggcuggugccugagucuaacaaugaagcgauggcucucgagccagucguuggagccucacuugcagccccggugacaggucagacuaacaucauugaccccuggauaagaacgaauuucguacaagcuccuaacggcgaauuuaccgugagucccaaaaauagcccaggggagauccuggucaacuuggaauuaggaccugagcugaauccauaccuagcacaccucgccaggauguauaacggcuacgcuggugggauggaggugcagguuaugcuggccggaaaugcguucacagcaggcaagauuaucuuugccgcugugcccccuuauuucccagucgaaaaccuuuccccgucucagauuacuauguuuccccaugugaucauagauguacggacccuggagccuguuuugcucccaaugcccgacgugcgcucgacacuguuccacuuuaaucagaaagaugaaccuaagaugcgacuggucgccaugcucuacaccccauuacguucaaacggcagcggggacgauguguucacugugaguugcagaauccugacaaggcccuccccggaguuugacuucaccuaucuugucccucccacgguugagucuaaaacuaagccauuuaccuugccugugcugacacuaggagaacucagcaauucccgguucccccugucaauugaugagaugguaaccaguccaaacgaaagcaucgugguccaaccccagaacggucgcgugacucuuuacggcgagcuguuggggacagcacagcuccaggcuuguaauauuugcucuaucagaggaaagguuaccggccaauuuccuaacgaacagaauauguggaaccuggagauaacgaauuuaaacgguacucaguucgaccugacagaugacgugccagccccgcucgggguccccgauuucgcgggagagguguuuggcguacuuucccagaggaaucggggcgaaucaaacccugccaaucgcgcacaugacgcuguuguggccaccuauagcgacaaauacacuccaaagcugggguugguccaaauuggaacauggaacaccaaugauguggagaaccagcccacgaaauucaccccuaucggucuaaaugaagucgcuaacggccaccgauuugagcaguggacacugccaagauacaguggggcccucacucugaauaugaaccuugcacccgccguggcuccgcuguucccuggagaaagguugcucuuuuuccggucuuauguuccacugaagggcgguuuugggaaccccgcgauugacuguuuagugccucaagaguggguacagcauuucuaccaggaguccgcacccagccugggcgaugucgcccuagugcguuauguuaauccagacaccggacgcgugcucuuugaagcuaaacugcacaagggcggguuccuuacagucucgucuacuuccaccggaccugugguagugcccgccaacgguuacuuuagauucgauucauggguuaaucaguuuuauaguuuggcaccaaugggcacagggaacggaaggcggcgauuccaauga

SEQ ID NO: 20127 - RNA, 1623 nt, Artificial Sequence
  derived and/or modified sequence opt3 from VP1__Norovirus_and/or_Norovirus-like__AY772730
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggagaucuuguuaaaucuggaacuaggaccugagcucaacccauaccuggcccaccuugcucggauguauaauggcuacgccgguggggucgaggugcagguucuguuggcgggaagcgcauucacggccggcaaacucguguuugcugccauucccccucauuucccagucgauaaccuguccccgggccagaucaccauguuuccccacgugauuaucgacguacgcacacuggaaccuguucucuuaccacugcccgaugugcgaaauaacuucuuucauuauaaucagcaaucugaccagcguaugagacuugucgcaauguuguacacuccucugaggucgaacgggucaggagaugacguguucaccgugagcugccggguccuaacacgcccaagucccgauuuugacuucaacuaucucguuccgccuaccguggaguccaagacuaaacccuuuucuguaccagugcugacacuuaaugaacugaccaacagcagauucccuguccccauagaugcuauguacacguccccaaaugacucaaucgugguucagccccagaacgguagggccacuauugauggcgaguugcucgggaccacacaacugaucccuaguggaauuuguagcuuucggggcaagaucacuacccacuuaucugacgaccgccaucuguggaauauacagguguccaaccucaaugguacaccauucgauccgaccgacgauguccccgcgccucuugggaugccagacuucucaggacagauuuuuggcgugguaagccagcgagauacgggcacuaaccccgccaauagagcacacgacgcugcccuggcuacauauagugccaaauacaccccuaaguuggggucuguucaaaucggagcaugggauacugaggaccuacuggaaaggcagccagugaaguucucccccgucggucucagcgagauuggccaggauaaacacuuugaccaaugggugcugccgaacuacucgggggcccuuggacugaauguccauuuggcuccugcggugucuccacucuuccccggcgaacggcuguuauuuuuccguuccuauaucccucugaagggugggcacggcgaucccuuuaucgacugccuaguuccacaggaguggauucagcauuucuaccaggaaucagccccugcacaaaguagcguggcucuccugcgcuauguaaaccccgacacaggaagaacccuuuuugaggccaaauugcacaaggagggcuucauaacggucuccucuaccgaaaauaggccagugaucguuccgccuaacggguacuuucgguucgauagcugggugaaucaguuuuauucacuggcacccaugggaacagguaacggccgacgcagaaugcaguga

SEQ ID NO: 20128 - RNA, 1623 nt, Artificial Sequence
  derived and/or modified sequence opt3 from VP1__Norovirus_and/or_Norovirus-like__KT315718
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauaauaaccagccaaacucccguaugagacugguugcaaugcuuuacacacccuugaggucuaaugggucgggagacgauguguucaccgucucaugccgggugcugacucgcccgacaccugacuuugaguucaccuaucuagugcccccaagcgucgaaaguaagacgaaaccuuuuucccuccccauucugacucuuucugagcugaccaacagcagauucccaguucccaucgauuccuuguuuacagcucaaaauaacgugcuccagguacagugucagaaugguaggugcacucuggacggcgaguuacaagggaccacacagcugcucccuucaggaauuugugccuuccggggccgcgugaccgcgcagaucaaccagcgagauagauggcauaugcaacuucagaaucugaacgguacgacuuacgacccaacagaugacgucccggcccccuuggggaccccugacuucaagggagugguuuuuggcauggugagucagaggaaugucggcaacgaugcaccagacagcacucgggcucaacaggccucuguguccacauauucaccccaguucguaccuaaacuagggagcguuaaucugcguauaaguaacaaugaugacuuucaguuccaaccaaccaaguuuacgcccgugggagucaacgaugacgaugacggucacccguuccgccagugggaacucccuaauuacucuggcgagcugacccuuaacaugaaccuggcuccacccguggccccuaauuuucccggggaacagcucuuguucuuuagauccuucgucccaugcagcggaggcuacaaccaggguauuaucgauugucugauuccucaagaguggauccagcauuuuuaucaggaaucggcacccucucaguccgacguggccuuaaucagguacguuaauccagauacagggcggacucuguucgaggcuaagcuacaccgaucaggcuauauuaccguggcgcacaguggagacuacccgcucguagucccugcaaacggccauuuucgcuucgacagcugggugaaucaauucuauucccuggcccccauggggacaggaaacgguagaaggcgggcucaguga

SEQ ID NO: 20129 - RNA, 1623 nt, Artificial Sequence
  derived and/or modified sequence opt3 from VP1__Norovirus_and/or_Norovirus-like__KT315708
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccaggggauuaucgauugucugauuccucaagaguggauccagcauuuuuaucaggaaucggcacccucucaguccgacguggccuuaaucagguacguuaauccagauacaggccggacucuguucgaggcuaagcuacaccgaucaggauauauuaccguggcgcacaguggcgacuacccgcucguagucccugcaaacggguauuuucgcuucgacagcugggugaaucaauucuacucccuggcccccaugggaacagguaacggcagaaggcgggcucaguga

SEQ ID NO: 20130 - RNA, 1623 nt, Artificial Sequence
  derived and/or modified sequence opt3 from VP1__Norovirus_and/or_Norovirus-like__KT315697
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccaggggauuaucgauugucugauuccucaagaguggauccagcauuuuuaucaggaaucggcacccucucaguccgacguggccuuaaucagguacguuaauccagauacaggccgggcucuguucgaggcgaagcuacaccgaucaggauauauuacuguggcacacaguggcgacuacccgcucguagucccugccaacgggcauuuucgcuucgacagcugggugaaucaauucuauucccuggcucccaugggaaccgguaacggcagaaggcgggcccaguga

SEQ ID NO: 20131 - RNA, 1623 nt, Artificial Sequence
  derived and/or modified sequence opt3 from VP1__Norovirus_and/or_Norovirus-like__KT315689
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccaggggauuaucgauugucugauuccucaagaguggauccagcauuuuuaucaggaaucggcacccucucaguccgacguggccuuaaucagguacguuaauccagauacaggccggacucuguucgaggcuaagcuacaccgaucaggauauauuaccgugagucacagcggcgacuacccgcucguagucccugcgaacgggcauuuucgcuucgacuccugggugaaucaauucuauucucuggcacccaugggaacagguaacggcagaaggcgggcccaguga

SEQ ID NO: 20132 - RNA, 1623 nt, Artificial Sequence
  derived and/or modified sequence opt3 from VP1__Norovirus_and/or_Norovirus-like__KX216805
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaccggaauuugugccuuccggggccgcgugacggcgcagaucaaucagcgagauagauggcauaugcaacuucagaaccugaaugguacuacauacgacccaaccgaugacgucccggcccccuuggggacuccugacuucaagggagugguuuuuggcauggugagucagaggaacgucggcaaugaugcaccagggagcacacgggcucaacaggccugggugucuaccuauucaccccaguucguaccuaaacuaggauccguuaaccugcguauaagcgacaaugaugacuuucaguuccaaccaacgaaguuuacccccgugggugucaacgaugacgaugacggccacccguuccgccagugggaacucccuaauuacaguggggagcugacacuuaacaugaaucuggcuccacccguggccccuaacuuucccggagaacagcucuuguucuuuagaucuuucgucccaugcuccggcgguuacaaccaggggauuaucgauugucugauuccucaagaguggauccagcauuuuuaucaggaaagcgcacccucgcagucugacguggccuuaaucagguacguuaauccagauacuggccggacccuguucgaggcuaagcuacaccgauccggauauauuacaguggcgcacucaggcgacuacccgcucguagucccugcaaacggguauuuucgcuucgacaguugggugaaucaauucuacagccuggcccccaugggaacugguaacggcagaaggcgggcucaguga

SEQ ID NO: 20133 - RNA, 1623 nt, Artificial Sequence
  derived and/or modified sequence opt3 from VP1__Norovirus_and/or_Norovirus-like__KU557859
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccagggggugauugauugucugaucccucaagaguggauucagcauuuuuaucaggaaucggcacccucucaguccgacguugccuuaaucagguacgugaauccagauacaggccggacucuguucgaggcuaagcuacaccgaucaggauauaucaccguagcgcacaguggcgacuacccgcucgucgugccugcaaacgggcauuuucgcuucgacagcuggguuaaucaauucuauucccuggcccccaugggaacagguaacggcagaaggcgggcucaguga

SEQ ID NO: 20134 - RNA, 1623 nt, Artificial Sequence
  derived and/or modified sequence opt3 from VP1__Norovirus_and/or_Norovirus-like__KU557828
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagacucuacucgggcucaacaggccuggguguccacauauucaccccaguucguaccuaaacuagggagcguuaaccugcguauaagugauaaugacgauuuucaguuccaaccaaccaaguuuacgcccgugggagucaacgacgaugacgauggucacccguuccgccagugggaacucccuaauuacucuggcgagcugacccuuaacaugaaucuggcuccacccguggccccuaacuuucccggggaacagcucuuguucuuuagauccuucgucccaugcagcggaggcuacaaccaggguauuaucgacugucugauuccucaagaguggauccagcauuuuuaucaggaaucggcacccucucaguccgauguggccuuaaucagguacguuaauccagacacagggcggacucuguucgaggcuaagcuacaccgaucaggcuauauuaccguggcgcacaguggagacuacccgcucguagucccugcaaacggccauuuucgcuucgauagcugggugaaucaauucuauucccuggcccccauggggacaggaaacgguagaaggcgggcucaguga

SEQ ID NO: 20135 - RNA, 1623 nt, Artificial Sequence
  derived and/or modified sequence opt3 from VP1__Norovirus_and/or_Norovirus-like__KT315692
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaguuuagaacugggcccagaucuaaaucccuaccucgcccaccugagccggauguauaacgguuacgcugggggaguggagguccaggugcuucuggccggcaaugcguucaccgcaggcaaaaucuuguuugccgcuguuccuccaaacuucccgguggaguuucucucccccgcccagauuacaaugcugccucaucugaucgucgacgugcgcacucucgaaccaauaaugauccccuuaccugauguacgaaauaccuucuuucacuauucuaaccagccaaauucgcguaugagacugguugcaaugcuuuacacacccuugaggucaaacgggagcggagacgauguguucaccgucaguugccgggugcugacucgcccgacaccugacuuugaguucaccuaucuagugcccccauccgucgaaucuaagacgaaaccuuuuagccuccccauucugacucuuuccgagcugaccaacucaagauucccaguucccaucgauaguuuguuuacagcucaaaauaacgugcuccagguacagugucagaaugguaggugcacucuggacggcgaguuacaagggaccacacagcugcucccuagcggaauuugugccuuccggggccgcgugaccgcgcagaucaaccagcgagauagauggcauaugcaacuucagaaucugaacgguacgacuuacgacccaacagaugacgucccggcccccuuggggaccccugacuucaagggagugguuuuuggcauggugucucagaggaaugucggcaacgaugcaccaggguccacucgggcucaacaggccugggugucaacauauagcccccaguucguaccuaaacuaggaaguguuaaucugcguauaucugacaacgaugacuuucaguuccaaccaaccaaguuuacgcccgugggugucaaugaugacgaugacggccacccguuccgccagugggaacucccuaacuacuccggggagcugacccuuaauaugaaccuggcuccacccguggccccuaauuuucccggagaacagcucuuguucuuuaggagcuucgucccaugcucgggcgguuacaaccaggggauuaucgauugucugauuccucaagaguggauccagcauuuuuaucaggaaucugcacccucccagucagacguggccuuaaucagauacguuaacccagauacaggccggacucuguucgaggcuaagcuacaccgaaguggauauauuaccguggcgcacagcggcgacuacccgcucguagucccugcaaaugggcauuuucgcuucgacuccugggugaaccaauucuauucucuggcccccaugggaacagguaauggcagaaggcgggcucaguga

SEQ ID NO: 20136 - RNA, 1623 nt, Artificial Sequence
  derived and/or modified sequence opt3 from VP1__Norovirus_and/or_Norovirus-like__KX168437
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagaggugcuguugaauuuagaacugggcccagaucuaaaccccuaccucgcccaccugagucggauguauaaugguuacgcugggggagucgaggugcagguucuucuggccggcaacgcguucaccgcaggcaaaauuuuguuugccgcugugccuccaaauuucccggucgaguuucucagccccgcccagaucacaaugcugccucaucugauuguggacguacgcacucucgaaccaaucaugauacccuuaccugauguucgaaacaccuucuuucacuauuccaaucagccaaacucucguaugagacugguggcaaugcuuuacacacccuugaggucgaacgggucaggagacgaugucuucaccgugagcugccgggugcugacucgcccgacaccugacuuugaguucaccuaucuaguucccccaagugucgaauccaagacgaaaccuuuuucucuccccauccugacucuuagcgagcugaccaauuccagauucccagugcccauugauucauuguuuacagcucaaaacaauguacuccaggugcagugucagaacgguaggugcacucuggacggcgaguuacaagggaccacacagcugcucccuaguggaaucugugccuuccggggccgcgucaccgcgcagauuaaucagcgagauagauggcauaugcaacuucagaaccugaaugguacgacuuacgacccaacagaugacgugccggcccccuuggggaccccugacuucaagggaguuguguuuggcauggucagccagaggaacgugggcaaugaugcaccagggucuacucgggcucaacaggccuggguauccacauauucaccccaguucguuccuaaacuaggaagcgugaaccugcguaucagugacaaugaugacuuucaguuccaaccaaccaaguuuacgcccgucggugugaacgaugacgaugacggccacccguuccgccagugggaacucccuaauuacucuggggagcugacccuuaacaugaaucuggcuccacccgucgccccuaacuuucccggagaacagcucuuguucuuuagauccuucgugccaugcagcggcgguuacaaccaggggauaauugauugucugaucccucaagaguggauucagcauuuuuaucaggaaucggcacccucucaguccgacguugccuuaaucagguacgugaauccagauacaggccggacucuguucgaggcuaagcuacaccgaucaggauauaucaccguagcgcacaguggcgacuacccgcucgucgugccugcaaacgggcauuuucgcuucgacagcuggguuaaucaauucuauucccuggcccccaugggaacagguaacggcagaaggcgggcucaguga

SEQ ID NO: 20137 - RNA, 1623 nt, Artificial Sequence
  derived and/or modified sequence opt3 from VP1__Norovirus_and/or_Norovirus-like__KX168440
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcucugaugcaccaggguccacucgggcucaacaggccugggugucaacauauagcccccaguucguaccuaaacuaggaaguguuaaucugcguauaucugacaacgaugacuuucaguuccaaccaaccaaguuuacgcccgugggugucaaugaugacgaugacggccacccguuccgccagugggaacucccuaacuacuccggggagcugacccuuaauaugaaccuggcuccacccguggccccuaauuuucccggagaacagcucuuguucuuuaggagcuucgucccaugcucgggcgguuacaaccaggggauuaucgauugucugauuccucaagagugggugcagcauuuuuaucaggaaucugcacccucccagucagacguugccuuaaucagauacgugaacccagauacaggccggacucuguucgaggcuaagcuacaccgaaguggauauaucaccguagcgcacagcggcgacuacccgcucgucgugccugcaaaugggcauuuucgcuucgacuccuggguuaaccaauucuauucucuggcccccaugggaacagguaauggcagaaggcgggcucaguga

SEQ ID NO: 20138 - RNA, 1623 nt, Artificial Sequence
  derived and/or modified sequence opt3 from VP1__Norovirus_and/or_Norovirus-like__KX216793
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcuggugccuaguggaauuugugccuuccggggccgcgucaccgcgcagaucaaucagcgagauagauggcauaugcaacuccagaaccuuaaugguacgacuuacgacccaacagaugacgugccggcaccccuggggaccccugacuucaagggaguuguguuuggcauggucagccagaggaacgugggcaaugaugccccagggucuacucgggcucaacaggccuggguauccacauauucaccccaguucguuccuaaauugggaagcgugaaccuacguauaagugacaaugaugacuuucaguuccaaccaaccaaguuuacgcccgucggugugaacgaugacgaugacggccacccguuccgccagugggaacugccuaauuacucuggggagcucacccugaacaugaaucuugcuccacccgucgccccuaacuuucccggagaacagcuguuguucuuuagauccuucgugccaugcagcggcgguuacaaccaggggauuaucgauugucucauuccucaagaguggauccagcauuuuuaucaggaaucggcacccucucaguccgacguugcccugaucagguacgugaauccagauacaggccggacuuuauucgaggcuaagcugcaccgaucaggauauauuaccguagcgcacaguggcgacuacccgcuagucgugccugcaaacgggcauuuucgcuucgacagcuggguuaaucaauucuauucccucgcccccaugggaacagguaacggcagaaggcgggcucaguga

SEQ ID NO: 20139 - RNA, 1623 nt, Artificial Sequence
  derived and/or modified sequence opt3 from VP1__Norovirus_and/or_Norovirus-like__KU557881
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagaucccuggucccaugcagcggcgguuacaaccaggggauuaucgauuguuuaauuccucaagaguggauccagcauuucuaucaggaaucggcacccucucaguccgacguggcccugaucagguacguuaauccagauacaggccggacucuauuugaggcuaagcuccaccgaucaggauauauuaccguggcgcacaguggcgacuacccgcugguagucccugcaaacgggcauuuccgcuuugacagcugggugaaucaauucuauucccuugcccccaugggaacagguaacggcagaaggcgggcucaguga

SEQ ID NO: 20140 - RNA, 1623 nt, Artificial Sequence
  derived and/or modified sequence opt3 from VP1__Norovirus_and/or_Norovirus-like__KY424350
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacaaccguaugagacugguugcaaugcuuuacacacccuugaggucuaaugggucgggagacgauguguucaccgucucaugccgggugcugacucgcccgacaccugacuuugaguucaccuaucuagugcccccaagcgucgaaaguaagacgaaaccuuuuucccuccccauucugacucuuucugagcugaccaacagcagauucccaguucccaucgauuccuuguuuacagcucaaaauaacgugcuccagguacagugucagaaugguaggugcacucuggacggcgaguuacaagggaccacacagcugcucccuucaggaauuugugccuuccggggccgcgugaccgcgcagaucaaccagcgagauagauggcauaugcaacuucagaaucugaacgguacgacuuacgacccaacagaugacgucccggcccccuuggggaccccugacuucaagggagugguuuuuggcauggugagucagaggaaugucggcaacgaugcaccagggagcacucgggcucaacaggccugggugucuacauauucaccccaguucguaccuaaacuaggauccauaaaucugcguauuagcgacaacgaugacuuucaguuccaaccaaccaaguuuacgcccguuggugugaaugaugacgaugacggccacccguuccgccagugggaacucccuaacuacaguggggagcugacccuuaauaugaaccuggcuccacccgucgccccuaacuuucccggagaacagcucuuguucuuuagaucuuucgugccaugcuccggcgguuacaaucaggggaucauugauugucugaucccucaagaguggauccagcauuuuuaucaggaaagcgcacccucgcagucugacgucgccuuaauuagguacgugaacccagauacaggccggacucuguucgaggcuaagcuacaccgauccggauauauaaccguugcgcacucaggcgacuacccgcucgugguaccugcaaaugggcauuuucgcuucgacaguugggucaaccaauucuauagccuggcccccaugggaacagguaauggcagaaggcgggcucaguga

SEQ ID NO: 20141 - RNA, 1623 nt, Artificial Sequence
  derived and/or modified sequence opt3 from VP1__Norovirus_and/or_Norovirus-like__KU557884
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaauggugccacguacgacccaacugaugacgucccggcacccuuggggacaccugacuucaagggagugguuuuuggcauggugagccagaggaacgucggcucugaugcuccaggguccacccgggcccaacaggcuugggugucaacuuauagcccccaguucguaccuaaacuaggaaguguuaaucugcguauaucugacaacgaugacuuucaguuccaaccaacaaaguuuacccccgugggugucaaugaugacgaugacggccacccguuccgccagugggaacucccuaacuacuccggggagcugacgcuuaauaugaaccuggccccacccguggcaccuaauuuucccggagaacagcucuuguucuuuaggagcuucgucccaugcucgggcgguuacaaccaggggauuaucgauugucugauuccucaagaguggauccagcauuuuuaucaggaaucugcccccucccagucagacguggcuuuaaucagauacguuaacccagauaccggccggacacuguucgaggcgaagcuacaccgaaguggauauauuacuguggcacacagcggcgacuacccgcucguagucccugccaaugggcauuuucgcuucgacuccugggugaaccaauucuauucucuggcucccaugggaaccgguaauggcagaaggcgggcccaguga

SEQ ID NO: 20142 - RNA, 1623 nt, Artificial Sequence
  derived and/or modified sequence opt3 from VP1__Norovirus_and/or_Norovirus-like__KU561253
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacaccuuccgccagugggaacucccgaauuacucuggggagcugacacuuaacaugaaucuggcuccuccaguggcccccaacuuuccuggagaacagcucuuguucuuuagauccuucguccccugcagcggcgguuacaaccaggggauuaucgauugucugauuccacaagaguggauccagcauuuuuaucaggaaucggcaccuucucaguccgacguggccuuaaucagguacguuaaucccgauacuggccggacccuguucgaggcuaagcuacaccgaucaggauauauuacaguggcgcacaguggcgacuacccacucguagucccggcaaacgggcauuuucgcuucgacagcugggugaaucaauucuauucccuggccccuaugggaacugguaacggcagaaggcgggcucaguga

SEQ ID NO: 20143 - RNA, 1623 nt, Artificial Sequence
  derived and/or modified sequence opt3 from VP1__Norovirus_and/or_Norovirus-like__KP902588
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcucugaugcaccaggguccacucgggcucaacaggccugggugucaacauauagcccccaguucguaccuaaacuaggaaguguuaaucugcguauaucugacaacgaugacuuucaguuccaaccaaccaaguuuacgcccgugggugucaaugaugacgaugacggccacccguuccgccagugggaacucccuaacuacuccggggagcugacccuuaauaugaaccuggcuccacccguggccccuaauuuucccggagaacagcucuuguucuuuagaagcucggucccaugcucuggcgguuacaaccaggggauuaucgauugucugauuccucaagaguggauccagcauuucuaucaggaauccgcacccucacagagugacguggccuuaaucagguacguuaacccagauacaggccggacucuguuugaggcuaagcuacaccgaagcggauauauuaccguggcgcacuccggcgacuacccgcucguagucccugcaaaugggcauuuccgcuuugacucuugggugaaccaauucuauagccuggcccccaugggaacagguaauggcagaaggcgggcucaguga

SEQ ID NO: 20144 - RNA, 1623 nt, Artificial Sequence
  derived and/or modified sequence opt3 from VP1__Norovirus_and/or_Norovirus-like__KX168456
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcucugaugcaccaggguccacucgggcucaacaggccugggugucaacauauagcccccaguucguaccuaaacuaggaaguguuaaucugcguauaucugacaacgaugacuuucaguuccaaccaaccaaguuuacgcccgugggugucaaugaugacgauggcgggcacccguuccgccagugggaacucccuaacuacuccggagagcugacccuuaauaugaaccuggcuccacccguggccccuaauuuucccggcgaacagcucuuguucuuuaggagcuucgucccaugcucggguggguacaaccagggcauuaucgacugucugauuccucaagaguggauccagcauuuuuaucaggaaucugcacccucccagucagauguggccuuaaucagauacguuaacccagacacaggacggacucuguucgaggcuaagcuacaccgaaguggcuauauuaccguggcgcacagcggggauuacccgcucguagucccugcaaauggacauuuucgcuucgacuccugggugaaccaauucuauucucuggcccccauggguacaggcaaugggagaaggcgggcucaguga

SEQ ID NO: 20145 - RNA, 1623 nt, Artificial Sequence
  derived and/or modified sequence opt3 from VP1__Norovirus_and/or_Norovirus-like__KX168444
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccaggggauuaucgauugucugauuccucaagaguggauccagcauuuuuaucaggaaucgucucccucccagucagacguggcauuaaucagguacguuaauccagauacaggccggacucuguucgaggccaagcuacaccgaaguggauauauuaccguggcucacagcggcgacuacccgcucguagucccugcgaacgggcauuuucgcuucgacuccugggugaaucaauucuauucucuggcacccaugggaacagguaacggcagaaggcgggcccaguga

SEQ ID NO: 20146 - RNA, 1623 nt, Artificial Sequence
  derived and/or modified sequence opt3 from VP1__Norovirus_and/or_Norovirus-like__KX216806
augaagauggccaccaacgacgcugcacccagcaaugauggcgccgcggggcuggugccugagggaaacaaugaaacacucccacuugagccggucgcuggugccgcaaucgccgcucccguuacuggccagaacaauauuauagacccuuggaucagaacgaacuucgugcaagcaccaaauggggaauuuaccguaucccccaggaacucuccuggagagauucuguugaauuuagaacugggcccagaucuaaaccccuaccucgcccaccugucacggauguauaaugguuacgcugggggaguggagguccaggugcuucuggccggcaacgcguucacagcaggcaaaaucuuguuugccgcuguuccuccaaauuucccgguggaguuucucagucccgcccagauuacuaugcugccucaucugaucgucgacgugcgcacccucgaaccaauaaugauccccuuaccugauguacgaaacacauucuuucacuauagcaaucagccaaacucccguaugagacugguugcaaugcuuuacacccccuugaggucuaacgggucgggagacgauguguucacugucucaugccgggugcugacacgcccgaccccugacuuugaguucacguaucuagugcccccaagcgucgaaaguaagacuaaaccuuuuucccuccccauucugacccuuucugagcugacaaauagcagauucccaguucccaucgauuccuuguuuacugcucaaaacaaugugcuccagguacagugucagaacgguaggugcacccuggacggcgaguuacaagggacaacccagcugcucccuucaggaauuugugccuuccggggccgcgugacggcgcagaucaaucagcgagauagauggcauaugcaacuucagaaccugaaugguacuacauacgacccaaccgaugacgucccggcccccuuggggacuccugacuucaagggagugguuuuuggcauggugagucagaggaacgucggcaaugaugcaccagggagcacacgggcucaacaggccugggugucuaccuauucaccccaguucguaccuaaacuaggauccguuaaccugcguauaagcgacaaugaugacuuucaguuccaaccaacgaaguuuacccccgugggugucaacgaugacgaugacggccacccguuccgccagugggaacucccuaauuacaguggggagcugacacuuaacaugaaucuggcuccacccguggccccuaacuuucccggagaacagcucuuguucuuuagaucuuucgucccaugcuccggcgguuacaaccaggggauuaucgauugucugauuccucaagaguggauccagcauuuuuaucaggaaagcgcacccucgcagucugacguggccuuaaucagguacguuaauccagauacuggccggacccuguucgaggcuaagcuacaccgauccggauauauuacaguggcgcacucaggcgacuacccgcucguagucccugcaaacgggcauuuucgcuucgacaguugggugaaucaauucuauagccuggcccccaugggaacugguaacggcagaaggcgggcucaguga

SEQ ID NO: 20147 - RNA, 1623 nt, Artificial Sequence
  derived and/or modified sequence opt3 from VP1__Norovirus_and/or_Norovirus-like__KX216794
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuugugagcugaccaauagcagauucccaguucccaucgauuccuuguuuacagcucaaaacaaugugcuccagguacagugccagaacgguagguguacucuggacggcgaguuacaagggaccacacagcugcucccuucaggaauuugcgccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagucagaggaacgucggcaaugaugcaccagggagcacucgggcucaacaggccugggugucuacauauucaccccaguucguaccuaaacuaggauccguuaaccugcguauaagcgacaaugaugacuuucaguuccaaccaaccaaguuuacgcccgugggugucaacgaugacgaugacggccacccguuccgccagugggaacucccuaauuacaguggggagcugacccuuaacaugaaucuggcuccacccguggccccuaacuuucccggagaacagcucuuguucuuuagaucuuucgucccauguuccggcgguuacaaccaggggauuaucgauugccugauuccucaagaguggauccagcauuuuuaucaggaaagcgcacccucgcagucugacguggccuuaaucagguacguuaauccagauacaggccggacucuguucgaggcuaagcuacaccgauccggauauauuaccguggcgcacucaggcgacuacccgcucguagucccugcaaacgggcauuuucgcuucgacaguugggugaaucaauucuauagccuggcccccaugggaacagguaacggcagaaggcgggcucaguga

SEQ ID NO: 20148 - RNA, 1623 nt, Artificial Sequence
  derived and/or modified sequence opt3 from VP1__Norovirus_and/or_Norovirus-like__KX420895
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugcccuccaggugcagugucagaacgguaggugcacucuggacggcgaguuacaagggaccacacagcugcucccuaguggaauuugugcguuccggggccgcguaaccgcccagaucaaucagcgagauagauggcauaugcaacuucagaaccugaaugguacgacuuacgacccaacagaugacgugccggcacccuuggggaccccugacuucaagggagucguguuuggcaugguuagccagaggaacgugggcaaugaugcuccagggucuacucgggcccaacaggcuugggucuccacauauucaccccaguucgugccuaaacuaggaagcguaaaccugcguauaagugacaaugaugacuuucaguuccaaccaaccaaguuuacgcccguuggugugaacgaugacgaugacggccacccguuccgccagugggaacucccuaauuacucuggggagcugacccuuaacaugaaucuggccccacccgucgcaccuuccuuucccggagaacagcucuuguucuuuaggagcuucgugccaugcucgggcgguuacaaccaggggauuaucgauugucugauuccucaagaguggauccagcauuuuuaucaggaaucugcccccucccagucagacgucgcuuuaaucagauacgugaacccagauacaggccggacucuguucgaggcgaagcuacaccgaaguggauauauuaccguugcacacagcggcgacuacccgcucgugguaccugccaaugggcauuuucgcuucgacuccugggucaaccaauucuauucucuggcucccaugggaacagguaauggcagaaggcgggcccaguga

SEQ ID NO: 20149 - RNA, 1623 nt, Artificial Sequence
  derived and/or modified sequence opt3 from VP1__Norovirus_and/or_Norovirus-like__KT591501
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagauccagguccuucuggccggcaacgcguucaccgcaggcaaaauuuuguuugccgcugugccuccaaauuucccgguugaguuucucagccccgcccagaucacaaugcugccucaucugauaguggacguccgcacucucgaaccaaucaugauucccuuaccugaugugcgaaacaccuucuuucacuauuccaaucagccaaacucucguaugagacugguagcaaugcuuuacacacccuugaggucgaacgggucaggagacgauguuuucaccgugagcugccggguccugacucgcccgacaccugacuuugaguucaccuaucuagugcccccaaguguggaauccaagacgaaaccuuuuucucuccccauccugacucuuagcgagcugaccaauuccagauucccaguccccauugauucauuguuuacagcucaaaacaauguucuccaggugcagugucagaacgguaggugcacucuggacggcgaguuacaagggaccacacagcugcucccuaguggaaucugugccuuccggggccgcguaaccgcgcagauaaaucagcgagauagauggcauaugcaacuucagaaccugaaugguacgacuuacgacccaacagaugacgugccggcccccuuggggaccccugacuucaagggagucguguuuggcaugguuagccagaggaacgugggcucugaugcaccaggguccacucgggcucaacaggccugggucucaacauauagcccccaguucgugccuaaacuaggaaguguaaaucugcguauuucugacaacgaugacuuucaguuccaaccaaccaaguuuacgcccguuggugugaaugaugacgaugacggccacccguuccgccagugggaacucccuaacuacuccggggagcugacccuuaauaugaaccuggcuccacccgucgccccuaauuuucccggagaacagcucuuguucuuuaggagcuucgugccaugcucgggcgguuacaaccaggggaucauugauugucugaucccucaagaguggauccagcauuuuuaucaggaaucugcacccucccagucagacgucgccuuaauuagauacgugaacccagauacaggccggacucuguucgaggcuaagcuacaccgaaguggauauauaaccguugcgcacagcggcgacuacccgcucgugguaccugcaaaugggcauuuucgcuucgacuccugggucaaccaauucuauucucuggcccccaugggaacagguaauggcagaaggcgggcucaguga

SEQ ID NO: 20150 - RNA, 1623 nt, Artificial Sequence
  derived and/or modified sequence opt3 from VP1__Norovirus_and/or_Norovirus-like__KT315714
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcucugaugcaccaggguccacucgggcucaacaggccuggauaucaacauauagcccccaguucgugccuaaacuaggaaguguaaaucugcguauuucugacaacgaugacuuucaguuccaaccaaccaaguuuacgcccguuggugugaaugaugacgaugacggccacccguuccgccagugggaacucccuaacuacuccggggagcugacccuuaauaugaaccuggcuccacccgucgccccuaauuuucccggagaacagcucuuguucuuuaggagcuucgugccaugcucgggcgguuacaaccaggggaucauugauugucugaucccucaagaguggauccagcauuuuuaucaggaaucugcacccucccagucagacgucgccuuaauuagauacgugaacccagauacaggccggacucuguucgaggcuaagcuacaccgaaguggauauauaaccguugcgcacagcggcgacuacccgcucgugguaccugcaaaugggcauuuucgcuucgacuccugggucaaccaauucuauucucuggcccccaugggaacagguaauggcagaaggcgggcucaguga

SEQ ID NO: 20151 - RNA, 1623 nt, Artificial Sequence
  derived and/or modified sequence opt3 from VP1__Norovirus_and/or_Norovirus-like__KT315673
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaaaaacucaccuggagagauucuguugaauuuagaacugggcccagaucuaaaccccuaccucgcccaccugaguaggauguauaaugguuacgcugggggaguggagguccaggugcuucuggccggcaacgcguucaccgcaggcaagaucuuguuugccgcuguuccuccaaauuucccgguggaguuucucagccccgcccagauuacaaugcugccucaucugaucgucgacgugcggacucucgaaccaauaaugauccccuuaccugauguacgcaacaccuucuuucacuauuccaaucagccaaacucucgaaugcgucugguugcaaugcuuuacacacccuugagaucgaacgggucaggagacgauguguucaccgucagcugcagggugcugacucggccgacaccugacuuugaguucaccuaucuagugcccccaagugucgaauccaaaacgaagccuuuuucucuccccauucugacucuuagcgagcugaccaauucccgcuucccaguucccaucgauucauuguuuacagcucaaaacaaugugcuccagguacagugucagaacgguagaugcacucuggacggcgaguuacaagggaccacacagcugcucccuaguggaauuugugccuucaggggccgggugaccgcgcagaucaaucagcgcgaucgauggcauaugcaacuucagaaccugaaugguacgacuuacgacccaacagaugacgucccggcccccuuggggaccccugacuucaaaggagugguuuuuggcauggugagccagagaaacgucggcaaugaugcaccagggucuacuagggcucaacaggccuggguguccacauauucaccccaguucguaccuaagcuaggaagcguuaaccugcggauaagugacaaugaugacuuucaguuccaaccaaccaaguuuacgcccgugggugucaacgaugacgaugacggccacccguuccgucagugggaacucccuaauuacucuggggagcugacccuuaacaugaaucuggcuccacccguggccccuaacuuucccggagaacagcucuuguucuuucgcuccuucgucccaugcagcggcgguuacaaccaggggauuaucgauugucugauuccucaagaguggauccagcauuuuuaucaggaaucggcacccucucaguccgacguggccuuaaucagauacguuaauccagauacaggcaggacucuguucgaggcuaaacuacaccggucaggauauauuaccguggcgcacaguggcgacuacccgcucguagucccugcaaacgggcauuuucgauucgacagcugggugaaucaauucuauucccuggcccccaugggaacagguaacggccgcagaagggcucaguga

SEQ ID NO: 20152 - RNA, 1623 nt, Artificial Sequence
  derived and/or modified sequence opt3 from VP1__Norovirus_and/or_Norovirus-like__KX216792
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagcauaacucucguaugagacugguugcaaugcuuuacacaccauugaggucgaacgggucaggagacgauguguucaccgucagcugccgggugcugacucgccccacaccggacuuugaguucaccuaucuagugccucccagugucgaauccaagacgaaaccauuuucucucccuauucugacucuuagcgagcugaccaauuccagauuccccguuccaaucgauucauuguuuacagcucaaaacaaugugcuccagguacagugucagaacgguaggugcacucuggacggcgaguuacaagggaccacacagcugcuccccaguggaauuugugccuuccggggccgcgugaccgcgcagaucaaucagcgagauagauggcacaugcaacuucagaaccugaaugguacgacuuacgacccuacagaugacgucccagccccguuggggacccccgacuucaagggagugguuuuuggcauggugagccagaggaacgucggcaaugaugcaccugggucuacucgggcucaacaggccuggguguccacauauucaccacaguucguacccaaacuaggaagcguuaacuuucguauaagugacaaugaugacuuccaguuucaaccuaccaaguucacgccagugggugucaacgaugacgaugacggccaucccuuucgccagugggaacugccgaauuacucuggggagcucacccugaacaugaaucuugcuccuccaguggcccccaacuucccuggagaacagcuguuguuuuucagauccuuuguccccugcagcggcgguuacaaccaggggauuaucgauugucucauuccacaagaguggauccagcacuucuaucaggaaucggcaccuucucaguccgacguggcccugaucagguacguuaaucccgauacaggccggacuuuauuugaggcuaagcugcaccgaucaggauauauuaccguggcgcauaguggcgacuacccgcuaguagucccagcaaacgggcacuuccgcuucgacagcugggugaaucaauuuuauucccucgccccuaugggaacagguaacggcagaaggcgggcucaguga

SEQ ID NO: 20153 - RNA, 1623 nt, Artificial Sequence
  derived and/or modified sequence opt3 from VP1__Norovirus_and/or_Norovirus-like__KU953398
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcacugaugcaccagggucuacacgggcucaacaggccuggguguccaccuauucaccccaguucguaccuaaacuaggaagcguuaaucugcguauaagugacaacgaugacuuucaguuccaaccaacgaaguuuacccccgugggugucaaugaugacgaugacggccacccguuccgccagugggaacucccuaacuacucuggggagcugacacuuaauaugaaccuggcuccacccguggccccuaauuuucccggagaacagcucuuguucuuuagauccuucgucccaugcagcggcgguuacaaccaggggauuaucgauugucugauuccucaagaguggauccagcauuuuuaucaggaaucggcacccucucaguccgacguggccuuaaucagguacguuaacccagauacuggccggacccuguucgaggcuaagcuacaccgaucaggauauauuacaguggcgcacaguggcgacuacccgcucguagucccugcaaaugggcauuuucgcuucgacagcugggugaaccaauucuauucccuggcccccaugggaacugguaauggcagaaggcgggcucaguga

SEQ ID NO: 20154 - RNA, 1623 nt, Artificial Sequence
  derived and/or modified sequence opt3 from VP1__Norovirus_and/or_Norovirus-like__KU557888
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaguacccagcugcucccuagcggaauuugugccuuccggggccgcgugacagcgcagaucaaucagcgagauagauggcauaugcaacuucagaaccugaaugguaccacguacgacccaacugaugacgucccggcccccuuggggacaccugacuucaagggagugguuuuuggcauggugucucagaggaacgucggcaaugaugcaccaggguccacccgggcucaacaggccugggugucaacuuauagcccccaguucguaccuaaacuaggaaguguuaaccugcguauaucugacaaugaugacuuucaguuccaaccaacaaaguuuacccccgugggugucaacgaugacgaugacggccacccguuccgccagugggaacucccuaauuacuccggggagcugacgcuuaacaugaaucuggcuccacccguggccccuaacuuucccggagaacagcucuuguucuuuaggagcuucgucccaugcucgggcgguuacaaccaggggauuaucgauugucugauuccucaagaguggauccagcauuuuuaucaggaaucugcacccucccagucagacguggccuuaaucagauacguuaauccagauaccggccggacacuguucgaggcuaagcuacaccgaaguggauauauuacuguggcgcacagcggcgacuacccgcucguagucccugcaaacgggcauuuucgcuucgacuccugggugaaucaauucuauucucuggcccccaugggaaccgguaacggcagaaggcgggcucaguga

SEQ ID NO: 20155 - RNA, 1623 nt, Artificial Sequence
  derived and/or modified sequence opt3 from VP1__Norovirus_and/or_Norovirus-like__KU557808
augaagauggccagcaacgacguggcucccuccaaugauggcgcagccgggcuggucccugagggaaacaaugaaacccucccacuugagccgguugcgggugcugccaucgcagcccccgugacaggccagaacaauauuauagacccuuggaucagaacuaacuucguacaagcuccaaauggggaauuuacggugucucccaggaacucaccuggagagauucuguugaauuuagaacugggcccagaucuaaaccccuaccucgcacaccugagucggauguauaaugguuacgccgggggagucgaggugcagguucuucuggcuggcaacgccuucaccgcgggcaaaaucuuguuugcagccgugccuccaaauuucccggucgaguuucucagccccgcucagauuacaaugcugccucaucugaucguggacguacgcacucucgaaccaauaaugauccccuuaccugauguucgaaacaccuucuuucacuauuccaaucagccaaacucucguaugagacugguggccaugcuuuacacacccuugaggucgaacgggucaggagacgaugucuucaccgugagcugccgggugcugacucgcccgacaccugacuuugaguucaccuaucuaguucccccaagugucgaauccaagacgaaaccuuuuucucuccccauucugacucuuagcgagcugaccaauuccagauucccagugcccaucgauucauuguuuacagcacaaaacaauguacuccaggugcagugucagaacgguaggugcacucuggacggcgaguuacaagggaccacacagcugcucccuaguggaauuugugcuuuccggggccgcgucaccgcccagaucaaucagcgagauagauggcauaugcaacuucagaaccugaaugguacgacuuacgacccaacagaugacgugccggcgcccuuggggaccccugacuucaagggaguuguguuuggcauggucagccagaggaacgugggcaaugaugccccagggucuacucgggcacaacaggcuuggguauccacauauucaccccaguucguuccuaaacuaggaagcgugaaccugcguauaagugacaaugaugacuuucaguuccaaccaaccaaguuuacgcccgucggugugaacgaugacgaugacggccacccguuccgccagugggaacucccuaauuacucuggggagcugacccuuaacaugaaucuggccccacccgucgcuccuaacuuucccggagaacagcucuuguucuuuagauccuucgugccaugcagcggcgguuacaaccaggggauuaucgauugucugauuccucaagaguggguucagcauuuuuaucaggaaucggcccccucucaguccgacguggcauuaaucagguacguaaauccagauacaggccggacucuguucgaggccaagcuacaccgaucaggauauaucaccgucgcucacaguggcgacuacccgcucgugguuccugcgaacgggcauuuucgcuucgacagcugggugaaucaauucuauucccuggcacccaugggaacagguaacggcagaaggcgggcccaguga

SEQ ID NO: 20156 - RNA, 1623 nt, Artificial Sequence
  derived and/or modified sequence opt3 from VP1__Norovirus_and/or_Norovirus-like__KU557807
augaagauggccagcaacgacguggcucccuccaaugauggcgcagccgggcuggucccugagggaaacaaugaaacccucccacuugagccgguugcgggugcugccaucgcagcccccgugacaggccagaacaauauuauagacccuuggaucagaacuaacuucguacaagcuccaaauggggaauuuacggugucucccaggaacucaccuggagagauucuguugaauuuagaacugggcccagaucuaaaccccuaccucgcacaccugagucggauguauaaugguuacgccgggggagucgaggugcagguucuucuggcuggcaacgccuucaccgcgggcaaaaucuuguuugcagccgugccuccaaauuucccggucgaguuucucagccccgcucagauuacaaugcugccucaucugaucguggacguacgcacucucgaaccaauaaugauccccuuaccugauguucgaaacaccuucuuucacuauuccaaucagccaaacucucguaugagacugguggccaugcuuuacacacccuugaggucgaacgggucaggagacgaugucuucaccgugagcugccgggugcugacucgcccgacaccugacuuugaguucaccuaucuaguucccccaagugucgaauccaagacgaaaccuuuuucucuccccauucugacucuuagcgagcugaccaauuccagauucccagugcccaucgauucauuguuuacagcacaaaacaauguacuccaggugcagugucagaacgguaggugcacucuggacggcgaguuacaagggaccacacagcugcucccuaguggaauuugugcuuuccggggccgcgucaccgcccagaucaaucagcgagauagauggcauaugcaacuucagaaccugaaugguacgacuuacgacccaacagaugacgugccggcgcccuuggggaccccugacuucaagggaguuguguuuggcauggucagccagaggaacgugggcaaugaugccccagggucuacucgggcacaacaggcuuggguauccacauauucaccccaguucguuccuaaacuaggaagcgugaaccugcguauaagugacaaugaugacuuucaguuccaaccaaccaaguuuacgcccgucggugugaacgaugacgaugacggccacccguuccgccagugggaacucccuaauuacucuggggagcugacccuuaacaugaaucuggccccacccgucgcuccuaacuuucccggagaacagcucuuguucuuuagauccuucgugccaugcagcggcgguuacaaccaggggauuaucgauugucugauuccucaagaguggauccagcauuuuuaucaggaaucggcccccucucaguccgacguugcauuaaucagguacgugaauccagauacaggccggacucuguucgaggccaagcuacaccgaucaggauauauuaccguagcucacaguggcgacuacccgcucgucgugccugcgaacgggcauuuucgcuucgacagcuggguuaaucaauucuauucccuggcacccaugggaacagguaacggcagaaggcgggcccaguga

SEQ ID NO: 20157 - RNA, 1623 nt, Artificial Sequence
  derived and/or modified sequence opt3 from VP1__Norovirus_and/or_Norovirus-like__KX371111
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaccggaauuugugccuuccggggccgcgugacggcgcagaucaaucagcgagauagauggcauaugcaacuucagaaccugaaugguacuacauacgacccaaccgaugacgucccggcccccuuggggacuccugacuucaagggagugguuuuuggcauggugagucagaggaacgucggcagcgaugcaccagggucuacacgggcucaacaggccuggguguccaccuauucaccccaguucguaccuaaacuaggaagcguuaaucugcguauaagugacaacgaugacuuucaguuccaaccaacgaaguuuacccccgugggugucaaugaugacgaugacggccacccguuccgccagugggaacucccuaacuacucuggggagcugacacuuaauaugaaccuggcuccacccguggccccuaauuuucccggagaacagcucuuguucuuuagauccuucgucccaugcagcggcgguuacaaccaggggauuaucgauugucugauuccucaagaguggauccagcauuuuuaucaggaaucggcacccucucaguccgacguggccuuaaucagguacguuaacccagauacuggccggacccuguucgaggcuaagcuacaccgaucaggauauauuacaguggcgcacaguggcgacuacccgcucguagucccugcaaaugggcauuuucgcuucgacagcugggugaaccaauucuauucccuggcccccaugggaacugguaauggcagaaggcgggcucaguga

SEQ ID NO: 20158 - RNA, 1623 nt, Artificial Sequence
  derived and/or modified sequence opt3 from VP1__Norovirus_and/or_Norovirus-like__KX371110
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcaugaucgauggcacaugcaacuucagaaccugaaugguacgacuuacgacccaacagaugacgucccggcccccuuggggaccccugacuucaagggagugguuuuuggcauggugagccagagaaacgucggcacugaugcaccagggucuacaagggcucaacaggccuggguguccaccuauucaccccaguucguaccuaaacuaggaagcguuaaucugcggauaagugacaacgaugacuuucaguuccaaccaacgaaguuuacccccgugggugucaaugaugacgaugacggccauccguuccgucagugggaacucccuaacuacucuggggagcugacacuuaauaugaaccuggcuccacccguggccccuaauuuucccggagaacagcucuuguucuuucgcuccuucgucccaugcagcggcgguuacaaccaggggauuaucgauugucugauuccucaagaguggauccagcacuuuuaucaggaaucggcacccucucaguccgacguggccuuaaucagauacguuaacccagauacuggcaggacccuguucgaggcuaagcuacaccggucaggauauauuacaguggcgcauaguggcgacuacccgcucguagucccugcaaaugggcacuuucgauucgacagcugggugaaccaauucuauucccuggcccccaugggaacugguaauggccgcagaagggcucaguga

SEQ ID NO: 20159 - RNA, 1623 nt, Artificial Sequence
  derived and/or modified sequence opt3 from VP1__Norovirus_and/or_Norovirus-like__KX134669
augaagauggccagcuccgacgcugcacccucuaacgauggcgccgcggggcuggugccugagggaaauaacgaaacccucccacuugagccggucgcuggugccgcaaucgccgcucccguuacaggccagaauaacauuauagacccuuggaucagaacuaauuucgugcaagcaccaaacggggaauuuacgguaucacccaggaauaguccuggagagauucuguugaacuuagaacugggcccagaucuaaaucccuaccucgcccaccugagccggauguauaacgguuacgcugggggaguggagguccaggugcuucuggccggcaaugcguucaccgcaggcaaaaucuuguuugccgcuguuccuccaaacuucccgguggaguuucucucccccgcccagauuacaaugcugccucaucugaucgucgacgugcgcacucucgaaccaauaaugauccccuuaccugauguacgaaauaccuucuuucacuauucuaaccagccaaauucgcguaugagacugguugcaaugcuuuacacacccuugaggucaaacgggagcggagacgauguguucaccgucaguugccgggugcugacucgcccgacaccugacuuugaguucaccuaucuagugcccccauccgucgaaucuaagacgaaaccuuuuagccuccccauucugacucuuuccgagcugaccaacucaagauucccaguucccaucgauaguuuguuuacagcucaaaauaacgugcuccagguacagugucagaaugguaggugcacucuggacggcgaguuacaagggaccacacagcugcucccuagcggaauuugugccuuccggggccgcgugaccgcgcagaucaaccagcgagauagauggcauaugcaacuucagaaucugaacgguacgacuuacgacccaacagaugacgucccggcccccuuggggaccccugacuucaagggagugguuuuuggcauggugucucagaggaaugucggcaacgaugcaccaggguccacucgggcucaacaggccugggugucaacauauagcccccaguucguaccuaaacuaggaaguguuaaucugcguauaucugacaacgaugacuuucaguuccaaccaaccaaguuuacgcccgugggugucaaugaugacgaugacggccacccguuccgccagugggaacucccuaacuacuccggggagcugacccuuaauaugaaccuggcuccacccguggccccuaauuuucccggagaacagcucuuguucuuuaggagcuucgucccaugcucgggcgguuacaaccaggggauuaucgauugucugauuccucaagaguggauccagcauuuuuaucaggaaucugcacccucccagucagacguggccuuaaucagauacguuaacccagauacaggccggacucuguucgaggcuaagcuacaccgaaguggauauauuaccguggcgcacagcggcgacuacccgcucguagucccugcaaaugggcauuuucgcuucgacuccugggugaaccaauucuauucucuggcccccaugggaacagguaauggcagaaggcgggcucaguga

SEQ ID NO: 20160 - RNA, 1623 nt, Artificial Sequence
  derived and/or modified sequence opt3 from VP1__Norovirus_and/or_Norovirus-like__KU557871
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugcccuccaggugcagugucagaacgguaggugcacucuggacggcgaguuacaagggaccacacagcugcucccuaguggaauuugugcguuccggggccgcguaaccgcccagaucaaucagcgagauagauggcauaugcaacuucagaaccugaaugguacgacuuacgacccaacagaugacgugccggcacccuuggggaccccugacuucaagggagucguguuuggcaugguuagccagaggaacgugggcaaugaugcuccagggucuacucgggcccaacaggcuugggucuccacauauucaccccaguucgugccuaaacuaggaagcguaaaccugcguauaagugacaaugaugacuuucaguuccaaccaaccaaguuuacgcccguuggugugaacgaugacgaugacggccacccguuccgccagugggaacucccuaauuacucuggggagcugacccuuaacaugaaucuggccccacccgucgcaccuaacuuucccggagaacagcucuuguucuuuagauccuucgugccaugcagcggcgguuacaaccaggggauuaucgauugucugauuccucaagaguggauccagcauuuuuaucaggaaucggcccccucucaguccgacgucgcuuuaaucagguacgugaauccagauacaggccggacucuguucgaggcgaagcuacaccgaucaggauauauuaccguugcacacaguggcgacuacccgcucgugguaccugccaacgggcauuuucgcuucgacagcugggucaaucaauucuauucccuggcucccaugggaacagguaacggcagaaggcgggcccaguga

SEQ ID NO: 20161 - RNA, 1623 nt, Artificial Sequence
  derived and/or modified sequence opt3 from VP1__Norovirus_and/or_Norovirus-like__KX371108
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagauccagguccuucuggccggcaacgcguucaccgcaggcaaaauuuuguuugccgcugugccuccaaauuucccgguugaguuucucagccccgcccagaucacaaugcugccucaucugauaguggacguccgcacucucgaaccaaucaugauucccuuaccugaugugcgaaacaccuucuuucacuauuccaaucagccaaacucucguaugagacugguagcaaugcuuuacacacccuugaggucgaacgggucaggagacgauguuuucaccgugagcugccggguccugacucgcccgacaccugacuuugaguucaccuaucuagugcccccaaguguggaauccaagacgaaaccuuuuucucuccccauccugacucuuagcgagcugaccaauuccagauucccaguccccauugauucauuguuuacagcucaaaacaauguucuccaggugcagugucagaacgguaggugcacucuggacggcgaguuacaagggaccacacagcugcucccuaccggaaucugugccuuccggggccgcguaacggcgcagauaaaucagcgagauagauggcauaugcaacuucagaaccugaaugguacuacauacgacccaaccgaugacgugccggcccccuuggggacuccugacuucaagggagucguguuuggcaugguuagucagaggaacgugggcagcgaugcaccagggucuacacgggcucaacaggccugggucuccaccuauucaccccaguucgugccuaaacuaggaagcguaaaucugcguauuagugacaacgaugacuuucaguuccaaccaacgaaguuuacccccguuggugugaaugaugacgaugacggccacccguuccgccagugggaacucccuaacuacucuggggagcugacacuuaauaugaaccuggcuccacccgucgccccuaauuuucccggagaacagcucuuguucuuuagauccuucgugccaugcagcggcgguuacaaccaggggaucauugauugucugaucccucaagaguggauccagcauuuuuaucaggaaucggcacccucucaguccgacgucgccuuaauuagguacgugaacccagauacuggccggacccuguucgaggcuaagcuacaccgaucaggauauauaacaguugcgcacaguggcgacuacccgcucgugguaccugcaaaugggcauuuucgcuucgacagcugggucaaccaauucuauucccuggcccccaugggaacugguaauggcagaaggcgggcucaguga

SEQ ID NO: 20162 - RNA, 1623 nt, Artificial Sequence
  derived and/or modified sequence opt3 from VP1__Norovirus_and/or_Norovirus-like__KU557829
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuacugacccuuggauaagaacgaacuucgugcaagcaccaaauggggaauuuaccguaucucccaggaacucaccuggagagauccuguugaauuuagaacugggcccagaucuaaaccccuaccucgcccaccugagucggauguauaaugguuacgcugggggaguggagguccaggugcuucuggccggcaacgcguucacagcaggcaaaauuuuguuugccgcuguuccuccaaauuucccgguggaguuucucagccccgcccagaucacuaugcugccucaucugauugucgacgugcgcacccucgaaccaaucaugauacccuuaccugauguacgaaacacauucuuucacuauuccaaucagccaaacucucguaugagacugguugcaaugcuuuacacccccuugaggucgaacgggucaggagacgauguguucacugucagcugccgggugcugacacgcccgaccccugacuuugaguucacguaucuagugcccccaagugucgaauccaagacuaaaccuuuuucucuccccauccugacccuuagcgagcugacaaauuccagauucccaguucccauugauucauuguuuacugcucaaaacaaugugcuccagguacagugucagaacgguaggugcacccuggacggcgaguuacaagggacaacccagcugcucccuaguggaaucugugccuuccggggccgcgugacggcgcagauuaaucagcgagauagauggcauaugcaacuucagaaccugaaugguacuacauacgacccaaccgaugacgucccggcccccuuggggacuccugacuucaagggagugguuuuuggcauggugagccagaggaacgucggcaaugaugcaccagacucuacacgggcucaacaggccuggguguccaccuauucaccccaguucguaccuaaacuagggagcguuaaccugcguaucagugauaaugacgauuuucaguuccaaccaacgaaguuuacccccgugggagucaacgacgaugacgauggucacccguuccgccagugggaacucccuaauuacucuggcgagcugacacuuaacaugaaucuggcuccacccguggccccuaacuuucccggggaacagcucuuguucuuuagauccuucgucccaugcagcggaggcuacaaccaggguauaauugacugucugaucccucaagaguggauucagcauuuuuaucaggaaucggcacccucucaguccgauguggccuuaaucagguacguuaauccagacacugggcggacccuguucgaggcuaagcuacaccgaucaggcuauaucacaguggcgcacaguggagacuacccgcucguagucccugcaaacggccauuuucgcuucgauagcugggugaaucaauucuauucccuggcccccauggggacuggaaacgguagaaggcgggcucaguga

SEQ ID NO: 20163 - RNA, 1623 nt, Artificial Sequence
  derived and/or modified sequence opt3 from VP1__Norovirus_and/or_Norovirus-like__KX168452
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccagcucccaucgauucauuguuuacagcccaaaacaauguucuccaggugcagugucagaacgguaggugcacucuggacggcgaguuacaagggaccacacagcugcucccuaguggaauuugugcguuccggggccgcguaaccgcccagaucaaucagcgagauagauggcauaugcaacuucagaaccugaaugguacgacuuacgacccaacagaugacgugccggcacccuuggggaccccugacuucaagggagucguguuuggcaugguuagccagaggaacgugggcucugaugcuccaggguccacucgggcccaacaggcuugggucucaacauauagcccccaguucgugccuaaacuaggaaguguaaaucugcguauaucugacaacgaugacuuucaguuccaaccaaccaaguuuacgcccguuggugugaaugaugacgaugacggccacccguuccgccagugggaacucccuaacuacuccggggagcugacccuuaauaugaaccuggccccacccgucgcaccuaauuuucccggagaacagcucuuguucuuuaggagcuucgugccaugcucgggcgguuacaaccaggggauuaucgauugucugauuccucaagaguggauccagcauuuuuaucaggaaucugcccccucccagucagacgucgcuuuaaucagauacgugaacccagauacaggccggacucuguucgaggcgaagcuacaccgaaguggauauauuaccguugcacacagcggcgacuacccgcucgugguaccugccaaugggcauuuucgcuucgacuccugggucaaccaauucuauucucuggcucccaugggaacagguaauggcagaaggcgggcccaguga

SEQ ID NO: 20164 - RNA, 1623 nt, Artificial Sequence
  derived and/or modified sequence opt3 from VP1__Norovirus_and/or_Norovirus-like__KU953393
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguagcauuugugccuuccggggacgcgugaccgcgcagaucaaucagcgagauagauggcauaugcaacuucagaaccugaauggcacgacuuacgacccaacagaugacgucccggcccccuuggguaccccugacuucaagggggugguuuuuggaauggugucucagaggaacgucggcuccgaugcaccaggcucaacucgggcucaacaggccugggugagcacauauaguccccaguucguaccuaaacuagggucuguuaaucugcguauauccgacaacgaugacuuucaguuccaaccaaccaaguuuacgcccgugggagucaaugaugacgaugacggucacccguuccgccagugggaacucccuaacuacagcggcgagcugacccuuaauaugaaccuggcuccacccguggccccuaauuuucccggggaacagcucuuguucuuuagaucguucgucccaugcucuggaggcuacaaccaggguauuaucgauugucugauuccucaagaguggauccagcauuuuuaucaggaauccgcacccucacagagugacguggccuuaaucagguacguuaacccagauacagggcggacucuguucgaggcuaagcuacaccgaagcggcuauauuaccguggcgcacuccggagacuacccgcucguagucccugcaaauggccauuuucgcuucgacucuugggugaaccaauucuauagccuggcccccauggggacaggaaaugguagaaggcgggcucaguga

SEQ ID NO: 20165 - RNA, 1623 nt, Artificial Sequence
  derived and/or modified sequence opt3 from VP1__Norovirus_and/or_Norovirus-like__KR052020
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccaggggauuaucgauugucugauuccucaagaguggauccagcauuuuuaucaggaaucggcacccucucagccagacguggccuuaaucagguacguuaauccggauacaggccggacucuguucgaggcuaagcuacaccgauccggauauauuaccguggcgcacucaggcgacuacccucucguaguccccgcaaacgggcauuuucgcuucgacaguugggugaaucaauucuauagccuggccccaaugggaacagguaacggcagaaggcgggcucaguga

SEQ ID NO: 20166 - RNA, 1623 nt, Artificial Sequence
  derived and/or modified sequence opt3 from VP1__Norovirus_and/or_Norovirus-like__KT315687
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaguaacgugcuccagguacagugucagaaugguaggugcacucuggacggcgaguuacaagggaccacacagcugcucccuaccggaauuugugccuuccggggccgcgugacggcgcagaucaaccagcgagauagauggcauaugcaacuucagaaucugaacgguacuacauacgacccaaccgaugacgucccggcccccuuggggacuccugacuucaagggagugguuuuuggcauggugagccagaggaaugucggcaacgaugcaccagggucuacacgggcucaacaggccuggguguccaccuauucaccccaguucguaccuaaacuaggaagcguuaaucugcguauaagugacaacgaugacuuucaguuccaaccaacgaaguuuacccccgugggugucaaugaugacgaugacggccacccguuccgccagugggaacucccuaacuacucuggggagcugacacuuaauaugaaccuggcuccacccguggccccuaauuuucccggagaacagcucuuguucuuuagauccuucgucccaugcagcggcgguuacaaccaggggauuaucgauugucugauuccucaagaguggauccagcauuuuuaucaggaaucggcacccucucaguccgacguggccuuaaucagguacguuaacccagauacuggccggacccuguucgaggcuaagcuacaccgaucaggauauauuacaguggcgcacaguggcgacuacccgcucguagucccugcaaaugggcauuuucgcuucgacagcugggugaaccaauucuauucccuggcccccaugggaacugguaauggcagaaggcgggcucaguga

SEQ ID NO: 20167 - RNA, 1623 nt, Artificial Sequence
  derived and/or modified sequence opt3 from VP1__Norovirus_and/or_Norovirus-like__KX356908
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucaguagcgauauuugugccuuccggggacgcgugaccgcgcagaucaaucagcgagacagauggcauaugcaacuucagaaccugaauggcacgacuuacgauccuacagacgacgucccagccccguuggguacccccgauuucaagggggugguuuuuggaauggugucucagaggaacgucggcuccgacgcaccuggcucaacucgggcucaacaggccugggugagcacauauaguccacaguucguacccaaacuagggucuguuaaucugcguauauccgauaacgacgauuuucaguuccaaccuaccaaguuuacgccagugggagucaaugacgaugacgauggucaccccuuccgccagugggaacucccgaacuacagcggcgagcugacccuuaauaugaaccuggcuccuccaguggcccccaauuuuccuggggaacagcucuuguucuuuagaucguucguccccugcucuggaggcuacaaccaggguauuaucgacugucugauuccacaagaguggauccagcauuuuuaucaggaauccgcaccuucacagagugauguggccuuaaucagguacguuaaccccgacacagggcggacucuguucgaggcuaagcuacaccgaagcggcuauauuaccguggcgcacuccggagaccauccacucguagucccggcaaauggccacuuucgcuucgauucuugggugaaccaauucuacagccuggccccuauggggacaggaaaugguagaaggcgggcucaguga

SEQ ID NO: 20168 - RNA, 1623 nt, Artificial Sequence
  derived and/or modified sequence opt3 from VP1__Norovirus_and/or_Norovirus-like__KX024652
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccacccaaccaaguuuacgcccgugggugucaacgaugacaaugauggcccgccuuuccgccaaugggaacucccaaacuacucuggggagcugacccuuaauaugaaccuggcucccccuguggcccccaacuuuccaggagaacagcucuuguucuuuagauccuucgucccuugcagcggcgguuacaaucaggggauuaucgacugucugauuccccaggaguggauccaacauuuuuaucaggaaucggcaccaucucaguccgauguggccuuaaucagguacguuaacccggacacaggccggacucuguucgaggcuaagcuacaccgaucaggauauauuaccguggcgcacaguggcgauuacccucucguaguccccgcaaaugggcauuuucgcuucgacagcugggugaaccaguucuauucccuggccccaaugggaacagguaauggcagaaggcgggcucaauga

SEQ ID NO: 20169 - RNA, 1623 nt, Artificial Sequence
  derived and/or modified sequence opt3 from VP1__Norovirus_and/or_Norovirus-like__KT315706
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaagugacuuugaguucaccuaucuagugccucccuccgucgaaucuaagacgaaaccauuuagccucccuauucugacucuuuccgagcugaccaauucaagauuccccguuccaaucgauaguuuguuuacagcucaaaacaaugugcuccagguacagugucagaacgguaggugcacucuggacggcgaguuacaagggaccacacagcugcuccccagcggaauuugugccuuccggggccgcgugaccgcgcagaucaaucagcgagauagauggcauaugcaacuucagaaccugaaugguacgacuuacgacccuacagaugacgucccagccccguuggggacccccgacuucaagggagugguuuuuggcauggugucucagaggaacgucggcaaugaugcaccuggguccacucgggcucaacaggccugggugucaacauauagcccacaguucguacccaaacuaggaaguguuaaccugcguauaucugacaaugaugacuuucaguuccaaccuaccaaguuuacgccagugggugucaacgaugacgaugacggccaccccuuccgccagugggaacucccgaauuacuccggggagcugacccuuaacaugaaucuggcuccuccaguggcccccaacuuuccuggagaacagcucuuguucuuuaggagcuucguccccugcucgggcgguuacaaccaggggauuaucgauugucugauuccacaagaguggauccagcauuuuuaucaggaaucugcaccuucccagucagacguggccuuaaucagauacguuaaucccgauacaggccggacucuguucgaggcuaagcuacaccgaaguggauauauuaccguggcgcacagcggcgacuacccacucguagucccggcaaacgggcauuuucgcuucgacuccugggugaaucaauucuauucucuggccccuaugggaacagguaacggcagaaggcgggcucaguga

SEQ ID NO: 20170 - RNA, 1623 nt, Artificial Sequence
  derived and/or modified sequence opt3 from VP1__Norovirus_and/or_Norovirus-like__KX134670
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacuaugccgacaccugacuuugaguucaccuaucuagugcccccaagugucgaauccaagacgaaaccuuuuucucuccccauucugacucuuagcgagcugaccaauucccgcuucccaguucccaucgauucauuguuuacagcucaaaacaaugugcuccagguacagugucagaacgguagaugcacucuggacggcgaguuacaagggaccacacagcugcucccuaccggaauuugugccuucaggggccgggugacggcgcagaucaaucagcgcgaucgauggcauaugcaacuucagaaccugaaugguacuacauacgacccaaccgaugacgucccggcccccuuggggacuccugacuucaagggagugguuuuuggcauggugagucagagaaacgucggcaaugaugcaccagggagcacaagggcucaacaggccugggugucuaccuauucaccccaguucguaccuaaacuaggauccguuaaccugcggauaagcgacaaugaugacuuucaguuccaaccaacgaaguuuacccccgugggugucaacgaugacgaugacggccacccguuccgucagugggaacucccuaauuacaguggggagcugacacuuaacaugaaucuggcuccacccguggccccuaacuuucccggagaacagcucuuguucuuucgcucuuucgucccaugcuccggcgguuacaaccaggggauuaucgauugucugauuccucaagaguggauccagcauuuuuaucaggaaagcgcacccucgcagucugacguggccuuaaucagauacguuaauccagauacuggcaggacccuguucgaggcuaagcuacaccgguccggauauauuacaguggcgcacucaggcgacuacccgcucguagucccugcaaacgggcauuuucgauucgacaguugggugaaucaauucuauagccuggcccccaugggaacugguaacggccgcagaagggcucaguga

SEQ ID NO: 20171 - RNA, 1623 nt, Artificial Sequence
  derived and/or modified sequence opt3 from VP1__Norovirus_and/or_Norovirus-like__KT780399
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugcacugugcugacacggccgaccccugacuuugaguucacguaucuagugcccccaagugucgaauccaagacuaaaccuuuuucucuccccauucugacccuuagcgagcugacaaauucccgcuucccaguucccaucgauucauuguuuacugcucaaaacaaugugcuccagguacagugucagaacgguagaugcacccuggacggcgaguuacaagggacaacccagcugcucccuacgggaauuugugccuucaggggccgggugacugcgcagaucaaucagcgcgaucgauggcauaugcaacuucagaaccugaaugguacaaccuacgacccaacugaugacgucccggcccccuuggggacaccugacuucaagggagugguuuuuggcauggugagucagagaaacgucggcaaugaugcaccagggagcaccagggcucaacaggccugggugucuacguauucaccccaguucguaccuaaacuaggauccguuaaccugcggauaagcgacaaugaugacuuucaguuccaaccaaccaaguuuacacccgugggugucaacgaugacgaugacggccacccguuccgucagugggaacucccuaauuacaguggggagcugacucuuaacaugaaucuggcuccacccguggccccuaacuuucccggagaacagcucuuguucuuucgcucuuucgucccaugcuccggcgguuacaaccaggggauuaucgauugucugauuccucaagaguggauccagcauuuuuaucaggaaagcgcacccucgcagucugacguggccuuaaucagauacguuaauccagauaccggcaggacacuguucgaggcuaagcuacaccgguccggauauauuacuguggcgcacucaggcgacuacccgcucguagucccugcaaacgggcauuuucgauucgacaguugggugaaucaauucuauagccuggcccccaugggaaccgguaacggccgcagaagggcucaguga

SEQ ID NO: 20172 - RNA, 1623 nt, Artificial Sequence
  derived and/or modified sequence opt3 from VP1__Norovirus_and/or_Norovirus-like__KP902577
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugcacugugcugacaaccccgacgccugacuuugaguucacuuaucuagugcccccaagugucgaauccaagaccaaaccuuuuucucuccccauucugacacuuagcgagcugacuaauucccgguucccaguucccaucgauucauuguuuaccgcucaaaacaaugugcuccagguacagugucagaacggucgcugcacacuggacggcgaguuacaagggaccacgcagcugcucccuacuggaauuugugccuucagaggcagggugacagcgcagaucaaucagcgggaucgcuggcauaugcaacuucagaaccugaaugguaccacuuacgacccaacagaugacgucccggcccccuuggggaccccugacuucaagggagugguuuuuggcauggugagucagcgaaacgucggcaaugaugcaccagggagcacgagagcucaacaggccugggugucuaccuauucaccccaguucguaccuaaacuaggauccguuaaccugaggauaagcgacaaugaugacuuucaguuccaaccaacaaaguuuacucccgugggugucaacgaugacgaugacggccacccguuccggcagugggaacucccuaauuacaguggggagcugacccuuaacaugaaucuggcuccacccguggccccuaacuuucccggagaacagcucuuguucuuucguucuuucgucccaugcuccggcgguuacaaccaggggauuaucgauugucugauuccucaagaguggauccagcauuuuuaucaggaaagcgcacccucgcagucugacguggccuuaauccgcuacguuaauccagauacaggcagaacucuguucgaggcuaagcuacacagguccggauauauuaccguggcgcacucaggcgacuacccgcucguagucccugcaaacgggcauuuucgguucgacaguugggugaaucaauucuauagccuggcccccaugggaacagguaacggccgacgcagagcucaguga

SEQ ID NO: 20173 - RNA, 1623 nt, Artificial Sequence
  derived and/or modified sequence opt3 from VP1__Norovirus_and/or_Norovirus-like__KU587628
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccauacggggaauuuacgguaucucccaggaacucaccuggagagauucuguugaauuuagaacugggcccagaucuaaaucccuaucucgcccaccugagucggauguacaacgguuaugcugggggaguggagguccaggugcuucuggccggcaaugcguucaccgcaggcaaaaucuuguuugccgcuguuccuccaaacuucccgguggaguuucucagccccgcccagauuacaaugcugccucaucugaucgucgacgugcgcacucucgaaccaauaaugauccccuuaccugauguacgaaauaccuucuuucacuacuccaaccagccaaauucucguaugagacugguugcaaugcuuuauacacccuugaggucgaacgggucaggagacgauguguucaccgucagcugccgggugcugacucgcccgacaccugacuuugaguucaccuaccuagugcccccaagugucgaauccaagaacaaaccuuuuucucuccccauuuucacgcugagcgagcuuacuaauuccagauuuccaguucccaucgauucacuguucaccgcucaaaacaauguguugcagguacagugucagaacgguaggugcacacucgacggcgagcugcaagggacuacccaguuacugccuacaggaauuugugccuuccggggccgcgugaccgcgcagaucaaucagcgagauagauggcauaugcaacuccagaaccuuaaugguacgacuuaugacccaacagaugacgucccggcaccccuggggaccccugacuuuaagggagugguuuucggcauggugagucagaggaacgucggcaaugaugccccagggagcacucgggcucaacaggccugggugucuacauacucaccccaguuuguaccuaaauugggauccguuaaccuacguauaagcgacaaugaugacuuccaguuucaaccaaccaaguucacgcccgugggugucaacgaugacgaugacggccacccguuucgccagugggaacugccuaauuacaguggggagcucacccugaacaugaaucuugcuccacccguggccccuaacuuccccggagaacagcuguuguuuuucagaucuuuugucccaugcuccggcgguuauaaccaggggauuaucgauugucucauuccucaagaguggauccagcauuucuaccaggaaagcgcacccucgcagucugacguggcccugaucagguauguuaauccagauacaggccggacuuuauuugaggcuaagcugcaccgauccggauacauuaccguggcgcacucaggcgacuauccgcuaguagucccugcaaacgggcauuuccgcuucgacaguugggugaaucaauuuuacagccucgcccccaugggaacagguaacggcagaaggcgggcucaguga

SEQ ID NO: 20174 - RNA, 1623 nt, Artificial Sequence
  derived and/or modified sequence opt3 from VP1__Norovirus_and/or_Norovirus-like__AF414409
augaagauggccagcaacgacgcugcacccuccaaugauggcgccgcggggcuggugccugagauuaacaaugaagucaugccacucgagccgguugcuggagccucucuugcaacccccgugguaggucagcaaaacauuauagacccuuggaucagaaauaacuucgugcaggccccagcuggcgaauuuacagucucacccaggaauaguccuggggagauucuguuggauuuagaacugggaccagagcuaaaccccuaccucgcacaccuggcccggauguauaauggccaugcuggugggauggaggugcagaucguucuugccggaaacgcguucacugcaggcaaaauuaucuuugccgcuauaccuccaggcuucccguacgaaaaucugagccccucccagaucacgaugugcccucacgugauuaucgacguccgccaauuggagccagugcuccugcccaugccugauauucgaaacaacuuuuuccauuauaaucaggggaaugacccaaagcugcgucucguagccauguuauacacaccccugagagcaaacaacucuggagaugacguuuuuaccgugucguguaggguccuuacuaaaccgucaccugauuucgaauuuaccuucuuggugcccccaacaguggagagcaagaccaaacaguuuacucugccuauccuaaagauaagugagaugacaaauucccgguuccccgucccaguugaaaugauguauaccucucgcaacgagaaucaggugguacaaccccagaacgguagagugacgcucgacggcgaacugcuugggacuaccccucuguuggcugucaauauuugcaaguuuaaaggagaggugaucgccaagaacggcgauguuaggagcuaccggauggacauggaaauuacaaauacugaugguaccccaaucgacccgacagaggacacccccgggccuaucggauccccagauuuccagggcauucucuucggcguggcgucacagcgcaacaaaaaugagcaaaaccccgccacgcgaagucacgaagcaaauauaaacacugggggagaccaguaugcuccuaagcuggcccaggucaaaaucuuuagccaaucucaggauuucgaggugcaucagccaacaguauuuacccccguugguguggcuggcgacacuucccacccguucagacaguggacauuaccuagguacgggggacaccugaccaauaacacgcaucucgccccagcagucgcuccccuuuuuccuggcgaacaaauucuguucuuucggucacagauccccagcaguggugggcacgaguugggcuacauggauugucuagugccacaggaauggguccagcauuucuaucaagaggccgcgaccgcacagucugagguggcccugauacguuuuauuaauccugacacaggacgcguucucuucgaagcuaagcugcacaagcagggcuuuaucacuguggcccacaccggggauaaccccaucguaaugccaccgaacggauacuucagauuugaggcaugggucaaucaguucuauucccuugccccuguggguacaggcaacgggaggcggcgaauccaauga

SEQ ID NO: 20175 - RNA, 1623 nt, Artificial Sequence
  derived and/or modified sequence opt3 from VP1__Norovirus_and/or_Norovirus-like__KT943504
augaagauggccagcaacgacgcugcacccuccaaugauggcgccgcggggcuggugccugagaucaacaaugaagucaugccacucgagccgguugcuggagccucucuugcaacccccgugguaggucagcaaaacauuauagacccuuggaucagaacaaauuucgugcaggccccagcuggcgaauuuacugucucacccaggaacaguccuggggagauucuguuggauuuagaacugggaccagagcuaaaucccuaccucgcacaccuggcccggauguauaacggccaugcuggugggauggaggugcagaucguucuugccggaaaugcguucacggcaggcaaaauuaucuuugccgcuauaccuccaggcuucccguacgaaaaccugagccccucccagaucaccaugugcccucacgugauuaucgacguccgccaauuggagccagugcuccugcccaugccugauauucgaaauaacuuuuuccauuauaaucaggggaacgacccaaagcugcgucucguagccauguuauacacaccccugagagcaaauaacucuggagaugacguuuuuacugugucguguaggguccuuaccaaaccgucaccugauuucgaauuuacauucuuggugcccccaaccguggagagcaagacuaaacaguuuacacugccuauccuaaagauaagugagaugaccaacucccgguuccccgucccaguugaaaugauguauacggcucgcaaugagaaccaggugguacaaccccagaaugguagagugacucucgacggcgaacugcuugggaccacaccucuguuggccgucaacauuugcaaguuuaaaggagagaucacugcgaagucuguggauguuaggagcuaccggauggacauggaaauuaccaauacagauggcaccccaaucgacccgacggaggacacucccgguccuaucggguccccagauuuccgcggcauucucuucggaguggccucacagcgaaacaaaggcgagcagauacccgcaacaagagcucacgaagccaauaucaacaccgggggagaccaauaugcuccuaagcuggcccaggucaaauuuuucagugguagccaggauuuugaggugcaucaaccaacuguauucacacccguuggcguggcaggggacucuucccacccguuucagcagugggccuuaccuagguacggaggccaccugaccaauaacacgcaucucgcuccagcggucgcaccccuuuucccuggugaacagauucuguuuuuccggucacaaauccccagcagugggggccacgagaugggauacauggauuguuuggugccacaggaauggguccagcauuuuuaucaggaggccgcuaccgcccaaucugagguggcacuaauacguuucguuaauccugacacaggccgcgugcuguuugaagccaagcuccacaagcagggguucauuacuguagcucacaccggagauaaccccaucgucaugccaccgaauggucauuuuagauucgaggccugggugaaccaguucuacucccuggcaccuguuggcacagggaauggaaggcggcgaauccaguga

SEQ ID NO: 20176 - RNA, 1623 nt, Artificial Sequence
  derived and/or modified sequence opt3 from VP1__Norovirus_and/or_Norovirus-like__KT943505
augaagauggccagcaacgacgcugcacccuccaaugauggcgccgcggggcuggugccugagaucaacaaugaagucaugccacucgagccgguugcuggagccucucuugcaacccccgugguaggucagcaaaacauuauagacccuuggaucagaacaaauuucgugcaggccccagcuggcgaauuuacugucucacccaggaacaguccuggggagauucuguuggauuuagaacugggaccagagcuaaaucccuaccucgcacaccuggcccggauguauaacggccaugcuggugggauggaggugcagaucguucuugccggaaaugcguucacggcaggcaaaauuaucuuugccgcuauaccuccaggcuucccguacgaaaaccugagccccucccagaucaccaugugcccucacgugauuaucgacguccgccaauuggagccagugcuccugcccaugccugauauucgaaauaacuuuuuccauuauaaucaggggaacgacccaaagcugcgucucguagccauguuauacacaccccugagagcaaauaacucuggagaugacguuuuuacugugucguguaggguccuuaccaaaccgucaccugauuucgaauuuacauucuuggugcccccaaccguggagagcaagacuaaacaguuuacacugccuauccuaaagauaagugagaugaccaacucccgguuccccgucccaguugaaaugauguauacggcucgcaaugagaaccaggugguacaaccccagaaugguagagugacucucgacggcgaacugcuugggaccacaccucuguuggccgucaacauuugcaaguuuaaaggagagaucacugcgaagucuguggauguuaggagcuaccggauggacauggaaauuaccaauacagauggcaccccaaucgacccgacggaggacacucccgguccuaucggguccccagauuuccgcggcauucucuucggaguggccucacagcgaaacaaaggcgagcagauacccgcaacaagagcucacgaagccaauaucaacaccgggggagaccaauaugcuccuaagcuggcccaggucaaauuuuucagugguagccaggauuuugaggugcaucaaccaacuguauucacacccguuggcguggcaggggacucuucccacccguuucagcagugggccuuaccuagguacggaggccaccugaccaauaacacgcaucucgcuccagcggucgcaccccuuuucccuggugaacagauucuguuuuuccggucacaaauccccagcagugggggccacgaguugggauacauggauugucuagugccacaggaauggguccagcauuuuuaucaggaggccgcuaccgcccaaucugagguggcacugauacguuucguuaauccugacacaggccgcgugcucuuugaagccaagcugcacaagcagggguucauuacuguagcucacaccggagauaaccccaucgucaugccaccgaauggucauuuuagauucgaggccugggugaaccaguucuacucccuugcaccuguuggcacagggaauggaaggcggcgaauccaguga

SEQ ID NO: 20177 - RNA, 1623 nt, Artificial Sequence
  derived and/or modified sequence opt3 from VP1__Norovirus_and/or_Norovirus-like__KT962982
augaagauggccagcaacgacgcugcacccuccaaugauggcgccgcggggcuggugccugagaucaacaccgaaacacucccacuugagccggucgcuggagccgcaauugccgcucccguuacuggucagaauaacauaaucgacccuuggauuagaaauaacuucgugcaagcaccaaauggcgaauuuacgguaucucccaggaacucaccuggggagauccugaugaauuuggaauuaggaccagaucugaaccccuaccuagcccaccucagucggauguauaauggcuacgcuggugggguggagguccaggugcugcuugccggaaacgcguucaccgcaggcaaaauucuguuugccgcuguuccuccaaauuucccgguggacauguugagccccgcccagaucacaaugcucccucaucugauagucgaugugcgcacucuggagccaaucaugauuccccucccugacguacgaaacgucuuuuaucacuucaauaaccagccagcaccccguaugagauuaguggcuaugcuguacaccccgcuuagguccaacggcucuggggaugacgucuuuacagugucgugccggguguugacccgcccuacucccgauuucgaauuuacauaucuggucccaccuucaguugagagcaagaccaaacccuucacgcuaccaauccucacuauuggagaacugaccaauaguagauuucccgccccuaucgaccaacuuuacacauccccaaacgcggaugugguagugcagccgcagaaugguagguguacucuggacggcgaguugcaggggaccacacaacuccugaccacggccauaugcucuuauaagggaacuacaagcaaccccaccuccgauuacugggacgaccauuuacugcaccucguccauccuaauggcgcaacuuacgauccaacagaggacgugcccgcuccuuucgguacccaggauuuucgggggauucuuuauggaguucugacgcagaacacccagaauccacgcgacgaagugucaaacagucgaggcaucuacauuagcucuacauccgauaaauucacucccaaguugggcaccaucgggcuacaccaaguccagggagacacagccucaaaucagcaaagcaaguucacuccgguggguaucgcuguaaaccagaauaccccuuuuaaacagugggagcugccaaacuauaguggcgcccucacacugaauaccaaccuugcacccgccguugggccuaauuuccccggagaacagauucuguuuuucagaucuaacgugccauccguccaaggcaaccacccuacucaggagauagauuguuugaucccccaggaaugggugagccauuuuuaccaggagucggcuccaucucaauccgacgucgcgcucgugagguauguuaauccggauacgggucggacaauuuucgaggcaaagcugcaccgucagggguuuaucaccauagccgcuacuggcucaaacccugugguaguucccccaaauggauacuuccgcuuugacaguugggugaaccaguucuaugccuuagcacccaugggcaccgggaauggaagaaggcgggcccaguga

SEQ ID NO: 20178 - RNA, 1623 nt, Artificial Sequence
  derived and/or modified sequence opt3 from VP1__Norovirus_and/or_Norovirus-like__KX079488
augaagauggccagcaacgacgcugcacccuccaaugauggcgccgcggggcuggugccugagaucaacaccgaaacacucccacuugagccggucgcuggagccgcaauugccgcucccguuacuggucagaauaacauaaucgacccuuggauuagaaauaacuucgugcaagcaccaaauggcgaauuuacgguaucucccaggaacucaccuggggagauccugaugaauuuggaauuaggaccagaucugaaccccuaccuagcccaccucagucggauguauaauggcuacgcuggugggguggagguccaggugcugcuugccggaaacgcguucaccgcaggcaaaauucuguuugccgcuguuccuccaaauuucccgguggacauguugagccccgcccagaucacaaugcucccucaucugauagucgaugugcgcacucuggagccaaucaugauuccccucccugacguacgaaacgucuuuuaucacuucaauaaccagccagcaccccguaugagauuaguggcuaugcuguacaccccgcuuagguccaacggcucuggggaugacgucuuuacagugucgugccggguguugacccgcccuacucccgauuucgaauuuacauaucuggucccaccuucaguugagagcaagaccaaacccuucacgcuaccaauccucacuauuggagaacugaccaauaguagauuucccgccccuaucgaccaacuuuacacauccccaaacgcggaugugguagugcagccgcagaaugguagguguacucuggacggcgaguugcaggggaccacacaacuccugaccacggccauaugcucuuaucggggaacuacaagcaaccccaccuccgauuacugggacgaccauuuacugcaccucguccauccuaauggcgcaacuuacgauccaacagaggacgugcccgcuccuuucgguacccaggauuuucgcgggauucuuuauggaguucugacgcagaacacccagaauccacgagacgaagugucaaacaguagaggcaucuacauuagcucuacauccgauaaguucacucccaaauugggcaccaucgggcuacaccaaguccagggagacacagccucaaaucagcaaagcaaguucacuccgguggguaucgcuguaaaccagaauaccccuuuuaagcagugggagcugccaaacuauaguggcgcccucacacugaauaccaaccuugcacccgccguugggccuaauuuccccggagaacagauucuguuuuucaggucuaacgugccauccguccaaggcaaccacccuacucaggagauagauuguuugaucccccaggaaugggugagccauuuuuaccaggagucggcuccaucucaauccgacgucgcgcucgugcgguauguuaauccggauacgggucguacaauuuucgaggcaaaacugcaccgccagggguuuaucaccauagccgcuacuggcucaaacccugugguaguucccccaaauggauacuucagauuugacaguugggugaaccaguucuaugccuuagcacccaugggcaccgggaauggaaggcggcgagcccaguga

SEQ ID NO: 20179 - RNA, 1623 nt, Artificial Sequence
  derived and/or modified sequence opt3 from VP1__Norovirus_and/or_Norovirus-like__KR921938
augaagauggccagcaacgacgcugcacccuccaaugauggcgccgcggggcuggugccugagaucaacaccgaaacacucccacuugagccggucgcuggagccgcaauugccgcucccguuacuggucagaauaacauaaucgacccuuggauuagaaauaacuucgugcaagcaccaaauggcgaauuuacgguaucucccaggaacucaccuggggagauccugaugaauuuggaauuaggaccagaucugaaccccuaccuagcccaccucagucggauguauaauggcuacgcuggugggguggagguccaggugcugcuugccggaaacgcguucaccgcaggcaaaauucuguuugccgcuguuccuccaaauuucccgguggacauguugagccccgcccagaucacaaugcucccucaucugauagucgaugugcgcacucuggagccaaucaugauuccccucccugacguacgaaacguguuuuaucacuucaauaaccagccagcaccccguaugagauuaguugcuaugcuguacaccccgcuuagguccaacggcucuggggaugacgucuuuacagugucgugccggguguugacccgcccuacucccgauuucgaauuuacauaucuggucccaccuucaguugagagcaagaccaaacccuucacgcuaccaauccucacuauuggagaacugaccaauaguagauuucccgccccuaucgaccaacuuuacacauccccaaacgcggaugugguagugcagccgcagaaugguagguguacucuggacggcgaguugcaggggaccacacaacuccugaccacggccauaugcucuuaucggggaacuacaagcaaccccaccuccgauuacugggacgaccauuuacugcaccucguccauccuaauggcgcaacuuacgauccaacagaggacgugcccgcuccuuucgguacccaggauuuucgcgggauucuuuauggaguucugacgcagaacacccagaauccacgagacgaagugucaaacaguagaggcaucuacauuagcucuacauccgauaaguucacucccaaauugggcaccaucgggcuacaccaaguccagggagacacagccucaaaucagcaaagcaaguucacuccgguggguaucgcuguaaaccagaauaccccuuuuaagcagugggagcugccaaacuauaguggcgcccucacacugaauaccaaccuugcacccgccguugggccuaauuuccccggagaacagauucuguuuuucaggucuaacgugccauccguccaaggcaaccacccuacucaggagauagauuguuugaucccccaggaauggauuagccauuuuuaccaggagucggcuccaucucaauccgacguggcgcucguccgguaugugaauccggauacgggucguacaaucuucgaggcaaaacugcaccgccagggguuuauaaccauugccgcuacuggcucaaacccuguugugguacccccaaauggauacuucagauuugacaguugggucaaccaguucuaugccuuagcacccaugggcaccgggaauggaaggcggcgagcccaguga

SEQ ID NO: 20180 - RNA, 1623 nt, Artificial Sequence
  derived and/or modified sequence opt3 from VP1__Norovirus_and/or_Norovirus-like__KR921940
augaagauggccagcaacgacgcugcacccuccaaugauggcgccgcggggcuggugccugagaucaacaccgaaacacucccacuugagccggucgcuggagccgcaauugccgcucccguuacuggucagaauaacauaaucgacccuuggauuagaaauaacuucgugcaagcaccaaauggcgaauuuacgguaucucccaggaacucaccuggggagauccugaugaauuuggaauuaggaccagaucugaaccccuaccuagcccaccucagucggauguauaauggcuacgcuggugggguggagguccaggugcugcuugccggaaacgcguucaccgcaggcaaaauucuguuugccgcuguuccuccaaauuucccgguggacauguugagccccgcccagaucacaaugcucccucaucugauagucgaugugcgcacucuggagccaaucaugauuccccucccugacguacgaaacgucuuuuaucacuucaauaaccagccagcaccccguaugagauuaguggcuaugcuguacaccccgcuuagguccaacggcucuggggaugacgucuuuacagugucgugccggguguugacccgcccuacucccgauuucgaauuuacauaucuggucccaccuucaguugagagcaagaccaaacccuucacgcuaccaauccucacuauuggagaacugaccaauaguagauuucccgccccuaucgaccaacuuuacacauccccaaacgcggaugugguagugcagccgcagaaugguagguguacucuggacggcgaguugcaggggaccacacaacuccugaccacggccauaugcucuuaucggggaacuacaagcaaccccaccuccgauuacugggacgaccauuuacugcaccucguccauccuaauggcgcaacuuacgauccaacagaggacgugcccgcuccuuucgguacccaggauuuucgcgggauucuuuauggaguucugacgcagaacacccagaauccacgagacgaagugucaaacaguagaggcaucuacauuagcucuacauccgauaaguucacucccaaauugggcaccaucgggcuacaccaaguccagggagacacagccucaaaucagcaaagcaaguucacuccgguggguaucgcuguaaaccagaauaccccuuuuaagcagugggagcugccaaacuauaguggcgcccucacacugaauaccaaccuugcacccgccguugggccuaauuuccccggagaacagauucuguuuuucaggucuaacgugccauccguccaaggcaaccacccuacucaggagauagauuguuugaucccccaggaaugggugagccauuuuuaccaggagucggcuccaucucaauccgacgucgcgcucgugcgguauguuaauccggauacgggucguacaaccuucgaggcaaaacugcaccgccagggguuuauuacuaucgccgcuaccggcucaaacccugugguaguucccccaaauggauacuucagauuugacaguugggugaaccaguucuaugccuuagcacccaugggcacagggaauggaaggcggcgagcccaguga

SEQ ID NO: 20181 - RNA, 1623 nt, Artificial Sequence
  derived and/or modified sequence opt3 from VP1__Norovirus_and/or_Norovirus-like__DQ358209
augaagauggccagcaacgacgcugcacccuccaaugauggcgccgcggggcuggugccugagaucaacaaugaagucaugccacucgagccgguugcuggagccucucuugcaacccccgugguaggucagcaaaacauuauagacccuuggaucagaaauaacuucgugcaggccccagcuggcgaauuuacagucucacccaggaauaguccuggggagauucuguuggauuuagaacugggaccagagcuaaaccccuaccucgcacaccuggcccggauguauaauggccaugcuggugggauggaggugcagaucguucuugccggaaacgcguucacugcaggcaaaauuguguuugccgcuaucccuccaggcuucccguacgaaaaucugagccccucccagauaacgaugugcccucacgucaucauugacgugcgccaauuggagccaguacuccugcugaugcccgauaucaagaacaacuuuuuccauuauaaucaggggaaugacccuaaacuccgauuaguugccaugcuguacaccccacuucgugcaaacaacucuggagaugacguguuuacagucucguguagaguguugacuaagcccucaccggauuucgaauuuaccuuccuggugccucccacagucgagagcaaaaccaagcaguuuacucuaccaauucucaagaucagugagaugacaaauuccagguucccuguucccguggaaaugauguauaccgcucggaacgagaaucagguagugcaaccacagaacggucgcgucacgcuggacggcgaacuucuggggacuacccccuugcucgccgugaauauaugcaaauuuaagggagagguuauugcgaaaaacggcgaugugagaucuuacaggauggacauggaaaucacaaauacugaugguaccccuauugacccaacagaggacaccccggggcccaucggaagcccugauuuccagggcauccuguucggcgucgccucccagcggaacaagaaugagcaaaacccagcaacgcgcgcucaggaagugaauauuaacacugggggagaccaguaugcccccaaauuagcucaaguaaaguuuuucucagagagucaggauuuugaaguucaccagccuacaguguucaccccagucgguguggccggcgaccccagccauccguuucgacaguggacucugccuagauacgggggacaccucacaaauaacauacaccuugcaccagccgucgcuccccuguucccuggcgagcaaaucuuguuuuucaggucucagauucccuccucaggugggcaugaacuaggcuacauggauugucuggugccacaggaguggguucagcacuuuuaucaagaggcggcaaccgcccagagcgaaguggcucucauccgguucauaaauccugacacgggacguguacuguuugaggccaaacuucauaagcagggcuucauuaccgucgcacacacaggggauaaccccaucgugaugccaccgaacggauacuuucgcuucgaagccuggguuaaucaguucuauagucuggcuccuguggguacuggcaacgggagaaggcggguccaauga

SEQ ID NO: 20182 - RNA, 1623 nt, Artificial Sequence
  derived and/or modified sequence opt3 from VP1__Norovirus_and/or_Norovirus-like__KP784694
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagacccuccaaauuuuccgacugagggccucucucccucacaggugacgauguucccucauaucauaguagauguucgccaacuggagccagugcuuaucccccugccugacguccgaaacaauuuuuaucacuacaaccagucgaaugauccaaccauuaaguugaucgcuaugcucuauacaccccugcgugccaacaacgcgggggacgauguguucacugugagcugcagaguccugaccaggccgaguccugacuuugauuucauuuuucucguucccccaacaguggaaucccggaccaaaccuuucucuguacccaucuuaacuguggaggaaaugacaaauagccgcuuuccaauaccccuggagaaacuuuucaccggaccuuccucagccuucgucgugcagccacagaacgguagauguacgacugacggcguuuugcuggggaccacacaacuaaguccggugaauauuugcacuuuuaggggagaugucacccauaucgcaggcagccacaacuacacaaugaaucucgcuacccagaacuggaacucuuaugaccccacggaggaaauuccugccccacuggguacucccgacuucguggggaagauccagggaguacuuacacagaccacuaagacagauggcuccacccggucacauaaggcuacgguuuacaccggcagcgccgacuuugcaccuaaacuggggcgcgugcaauucgagacagauacuaauaaugacuuugaaaccaaccagaauacaaaguucacuccagucggagugauccagaacggugagaccgcccaccgaaaugaaccccaacagugggucuugccgaguuacucuggcagaaacacaccuaaugugcaccucgcuccagcgguugcacccaccuuuccuggggagcagcuguuauucuuuagguccacuaugcccggauguagcggcuauccaaacauggaucuggacugccuccuuccucaggagugggugcaauacuucuaucaggaagccgcucccgcccagucggauguagcacuguugcgguuugucaacccagacacgggucgugugcuauucgaguguaaacugcauaagucuggguacguuacaguggcccacaccggcucccaugaucucgucauuccgccuaauggauauuuucgcuucgacucaugggugaaccaguucuacacucuggcucccaugggcaaugggaccggaagaaggcgggccacauga

SEQ ID NO: 20183 - RNA, 1623 nt, Artificial Sequence
  derived and/or modified sequence opt3 from VP1__Norovirus_and/or_Norovirus-like__KX354064
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcagcacuacccacaggaaugagccccaacaguggguauugccgaguuacucugggcggaacacacacaauguccaucucgccccugcuguggcgccaaccuuucccggagaacagcuguuauucuuucguuccacuaugccuggcuguagcgguuaucccaacauggaccuggauugccuccuuccacaggaguggguucaauacuucuaucaggaggcagccccugcucagucggacguggcccuguugcgcuuugucaaucccgauacggggagagugcuauucgaauguaagcugcacaaaucuggcuacguaacaguggcacauaccggacagcacgaccucguuauuccaccgaacggcuauuuuagguucgauuccugggucaaccaauucuacacucuggccccuauggggaauggaaccggucggcgacgcgcuauguga

SEQ ID NO: 20184 - RNA, 1623 nt, Artificial Sequence
  derived and/or modified sequence opt3 from VP1__Norovirus_and/or_Norovirus-like__LC177658
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacugggugcccccgacuucgucgggaagauucagggaaugcuuacucagacaacccgcgcugacggcuccacucgaggccacaaggccacaguguacaccgggucagcagauuuugccccuaagcugggaagaguccaauucgagacggacaccgaucaugacuuugaagcuaaucagaacacaaaauucacuccaguggguguuauccaggauggcgggaccacacacaggaaugagccccaacaguggguguugccgagcuacaguggacggaacacucacaauguacaucucgcgccugcagucgccccaaccuuucccggcgaacagcuguuauucuuucguucuacaaugccugguuguuccggguaucccaacauggaccuggauugccuccuuccacaggagugggugcaauacuucuaucaggaggcugccccugcacagagcgacguugcccuguugcgcuuugugaaucccgauaccggcagaguccuauucgaauguaagcugcacaaaucgggauacgugacuguagcucauacgggccagcacgaccucgugauuccaccgaacggguauuuuagguucgauucuuggguuaaccaauucuacacacuggccccuaugggaaauggugcaggccggcgacgcgucgcguga

SEQ ID NO: 20185 - RNA, 1623 nt, Artificial Sequence
  derived and/or modified sequence opt3 from VP1__Norovirus_and/or_Norovirus-like__KX514232
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagacaccacgaacgauuuggacgcacaucaaaauaccaaauucacacccgucggugugguucagggcggggaaaguccgcagaggucugagccucaacagugggugcucccauccuauagcggacgggauacucccaacguacaccuggccccugcugucgcgcccaccuuuccaggcgaacaguuacuguucuuucguucgacaaucccugguugugggggccaccccaauaugaaccucgacugccuucugccacaggagugggugcaacauuucuaccaggaggcagccccggcucagucugauguugccuugcuacgcuuugugaauccugacacuuccagaguccuguucgaauguaagcuccacaaaucaggauaugugaccguagcacauacaggccagcacgaucuggugauucccccaaacggguacuuuagguucgacaguuggguuaaccaauuuuauacccuugcccccaugggaaaugguacuggccggaagcgagcuagcuga

SEQ ID NO: 20186 - RNA, 1623 nt, Artificial Sequence
  derived and/or modified sequence opt3 from VP1__Norovirus_and/or_Norovirus-like__LC145787
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuuccccgugucuauagaucagauguacaccagcccaaacgaggucaucuccgugcagugucagaacgguagaugcacacuugacggcgaacugcaagggacuacccaguugcagguuucaggaauuugugccuuuaagggcgaggugacagcacaccuccaugauaaugaccaccuguauaacgucaccaucacgaauuuaaacgguagucccuucgacccuagcgaagaugugccagcuccgcuggggguacccgacuuccagggaaggguuuuuggcauuaucucucaacgggauaagcacaauuccccuggccauaacgagccagccaaucgcgggcacgacgcugugguccccacuuacacagcccaguacaccccuaaacucggacagauacaaauugguacuuggcagacagaugaccuuaccgugaaccagccagucaaguucacgcccgugggccugaaugauaccgaacauuuuaaccaguggguugugccgcgauaugcaggggccuugaaucuaaacacaaaucuggcuccuucaguagcgccagucuuccccggagagagacuccuguuuuucaggagcuacgugccucuuaaaggcgguuaugggaaccccgcaaucgacugccuguugccacaagaguggguucagcacuuuuaccaggaagccgcuccuaguaugucugagguggcccucguccgguauauuaaucccgauacuggccgugcacuguucgaagccaaguuacaccgcgcuggauuuaugaccguguccagcaacacaucggccccaguagugguuccggcaaacggcuacuucagauuugacucuugggucaaucaguucuauucccuggcgccuauggggacuggaaacgguaggcggcgauga

SEQ ID NO: 20187 - RNA, 1623 nt, Artificial Sequence
  derived and/or modified sequence opt3 from VP1__Norovirus_and/or_Norovirus-like__KT962983
augaagauggccagcaacgacgcugcacccuccaccgauggcgccgcggggcuggugccugagucuaauacagaagucauggcucucgagccaguugccggagcagcccuugcugcaccggugacuggucagacgaacaucauugaccccuggauaagagccaauuucguacaagcuccuaacggcgaauuuaccgugucaccaaggaaugcccccggggagguccuguugaacuuagaacugggaccugagcuaaauccauaccucgcgcaccuggcacggauguauaacggcuacgccggugggauggaggugcagguuaugcuugcuggaaaugccuucacagcaggcaaacugguguuugcugccgugcccccucauuucccagucgaaaacuugaguccgcagcagaucacuauguuuccccacguaauuaucgauguucgcacccucgagccugugcugcugccacuccccgacguccgaaauaacuucuuucauuauaaucaaaaggaugacccuaaaaugcguauuguggcgauguuauacacaccacugagaagcaacggcuccggggaugacguguucaccgucucuugcaggguucuuacucggcccucgccggauuuugacuucacauauuuggugccucccaccguagaaucaaagacgaaaccauuuacucugccuauccuaacccucggagagcugagcaauagucgcuuccccguguccauagaucagauguacacaucuccaaacgaggucaucagcgugcagugucagaacgguagaugcacucuugacggcgaacugcaagggaccacacaguugcagguuuccggaauuugugccuuuaagggcgaggugaccgcacaccuccaugauaaugaccaccuguauaacaucacgauuacuaauuuaaacgguucacccuucgacccuagugaagauaucccagcuccgcuggggguccccgacuuccagggaaggguguuuggcauaauuagccaacgggauaagcacaauucuccuggccauaacgagccagccaaucgcgggcacgacgcuguaguucccacauacaccgcccaguacacuccuaaacucggacagauccaaauugguacauggcagaccgaugaccuuacggugaaccagccagucaaguucacccccgugggccugaaugauacagaacauuuuaaccagugggucgugccgcgauaugcaggggccuugaaucuaaacacuaaucuggcuccuuccguugcgccaguguuccccggagagagacuccuguuuuucaggucauacaucccucuuaaaggcgguuaugggaaccccgcaaucgacugccuguugccacaagaguggguacagcacuuuuaccaggaagccgcuccuagcaugagugaggucgcccucgugcgguauauuaaucccgauaccggccgugcacuguucgaagccaaguuacaccgcgcuggauuuaugacaguuucuuccaacacuagcgccccaguggucgugccggcaaacggcuacuucagauuugacucguggguaaaucaguucuauucucuggcgccuauggggaccggaaacgguaggcggcgauga

SEQ ID NO: 20188 - RNA, 1623 nt, Artificial Sequence
  derived and/or modified sequence opt3 from VP1__Norovirus_and/or_Norovirus-like__AB629946
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuucaccgugucuauagaucagauguacacaagccuuaacgaggucaucuccgugcagugucagaacgguagaugcacucuggacggcgaauugagggggaccacacaacuccagguuucaggaauuugugccuuuaagggcgaggugaccgcacacguccaugauaaugaccaccuguauaacgugacgaucacuaauuuaaacgguagucccuucgacccaagcgaagauguacccgcuccucuggggguuccagacuuccagggacggguguuuggcauuaucucucagcgcgauaagcacaauuccccgggccauaacgagcccgccaaucgagggcacgacgcugucgugccuacauacaccgcccaauacacuccaaaacucggacagauacagauugguacauggcaaaccgaugaccuuacggucaaccagcccgugaaguucaccccuguuggccugaaugauacagaacauuuuaaccagugggugguaccaagauaugcaggggccuugaaucuaaacacuaaucuggcucccucagucgcgccgguguucccuggagagaggcuccuguuuuuccggagcuacguuccacuuaaaggcgguuaugggaaccccgcaaucgacugccuguugccucaggagugggugcaacacuuuuaccaggaagccgcucccaguaugucugaggucgcccucgugcguuauauuaauccagauaccggccgcgcacuguucgaagccaaguuacacagagcuggauuuaugacaguauccagcaacacuucggccccugugguuguccccgcaaacggcuacuucagguuugacucuugggugaaucaguucuauucccuggcgccaauggggaccggaaacggucggcgacgcuga

SEQ ID NO: 20189 - RNA, 1623 nt, Artificial Sequence
  derived and/or modified sequence opt3 from VP1__Norovirus_and/or_Norovirus-like__AB809993
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcggggucaggacgcuuucauugauugucuccugccccaggaaugggucaaucacuuuuaccaagaggccgcaccaucccaggccgacguggcuuuaauccguuauguuaacccugauacagggcgcacucuguucgaagccaaacuacacagaucaggcuuuauaaccgugagucauacaggagcauacccccucguagucccaccgaacggccacuucagguuugacagcugggugaaucaguucuauucccuggcgccuauggggaccggaaacggucggcgacgcuga

SEQ ID NO: 20190 - RNA, 1623 nt, Artificial Sequence
  derived and/or modified sequence opt3 from VP1__Norovirus_and/or_Norovirus-like__JQ743330
augaugauggccagcaaggacgcucccccuaacauggauggcaccuccggggcaggacagcuggugccagaggccaauacagcggaaccgaucucuauggagcccgucgcuggugccgcaacugccgcugcaacggccggccaaguuaacaugauugacccuuggauaaugaauaacuacgugcaggcuccacagggggaguucaccaucucacccaauaacacaccuggagauauucucuuugaccuucagcugggcccacacuugaaucccuucuuaagucaucuggcccaaauguauaacgguuggguagggaauaugaaagugaagguccuacucgcgggaaacgcauuuacugccggcaaaaucauuaucagcugcauaccuccaggcuucgcugcccagaauaucuccauugcacaggcuaccauguuuccgcacgugaucgccgauguuagagugcuggaacccauugaagucccucuugaggacgugaggaacguacuguuccauaauaacgauaauacaccaaccaugcgguugguuuguaugcucuacacuccccugcgcgcgucugggucgucaagcggaacagacccuuuugugaucgccggucgaguccugaccugcccaagucccgauuucuccuuucucuucuuagugccgccuaacguggagcagaagacgaaacccuuuucugucccaaaccugccucuuaauacuuugagcaacucccguguucccucacugauaagaaguaugauggugagcagggaccacggccaaaugguacaguuccagaaugggcgggugacccuagauggacagcuccaaggcacaacuccaaccucugcaucccagcuguguaagauucgcgguucagucuuucaugcuaacgggggaaauggcuauaaccuuacagaacuggacggcagccccuaccacgccuucgagaguccugcuccaaucggguucccggauuugggagaaugcgacuggcacauggaggccucucccaccacgcaguuugacacuggugaugugauuaagcaaaucaauguuaaacaggaggcagccuucgcuccucaucucggcacaauccaggcggacgggcuguccgaugugagcgucaacaccaauaugauugcaaaguuaggaugggugucgccaguaucugacggccacagagguuccguugaucccugggugauaccuagguaugggucaacucugacagaagccgcucagcucgccccacccaucuacccgccuggcuuuggagaggcaauugucuucuuuaugagugacuucccaaucgcccauggcgcuaacgggcuuagcgugcccuguaccauaccucaagaauuugucacgcacuucgugaaugagcaggcccccacccggggagaagcagcgcuguugcacuaucuagauccagacacacaucgcaaccugggugaguuuaaacucuacccugagggcuucaugacuugcguucccaauuccucugggaccggaccacagacacugccgauuaacggcguguuugcuuucguaagcugggucucacgauuuuaccagcuuaagccuguggguacugccgggcccgcaagaaggcuguga

SEQ ID NO: 20191 - RNA, 1623 nt, Artificial Sequence
  derived and/or modified sequence opt3 from VP1__Norovirus_and/or_Norovirus-like__AF439267
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauauucucuuugaccuucagcugggcccucacuugaauccauucuuaagucaucuggcccaaauguauaacgguuggguagggaauaugaaagugaagguccuacucgcgggaaacgcauuuaccgccggcaaaaucauuaucagcugcauacccccuggcuucgcugcccagaauaucuccauugcacaggcuacaauguuuccacacgugaucgccgauguuagagugcuggaaccgauugaagucccccuugaggacgugaggaacguacuguuccauaauaacgauaauaccccuacuaugcgguugguuuguaugcucuacacaccacugcgcgcgucugggucgucaagcggaaccgaccccuuugugaucgccggucgaguccugacgugcccuaguccagauuucuccuuucucuucuuagugcccccgaacguggagcagaagacuaaaccuuuuucuguccccaaccugccacuuaauaccuugagcaacucccguguuccuucacugauaaagaguaugauggugagcagagaccacggccaaaugguacaguuccagaaugggagggugacacuagauggacagcuccaaggcacuacccccacaucugcaucccagcuguguaagauucgggguucagucuuucaugcuaacgggggaaauggcuauaaccuuaccgaacuggacggcagcccauaccacgccuucgagagucccgcuccugugggguucccagauuugggagaaugcgacuggcacauggaggccucuccgacgacucaguuuaauacaggugacguuaucaaacaaauuaacgugaagcaggaguccgcauucgcuccccaucucggcaccauccaggccgaugggcugagcgacgucucggugaauacuaacaugaucgcgaaauuaggauggguaucuccuguuuccgauggccacaagggugacguggauccaugggucauuccccgcuaugggucaacacugaccgaagcagcccagcucgcuccuccaauauaucccccgggcuuuggagaggccaucguguucuuuaugagugacuucccuauugcacauggcacgaaugggcuuagcgucccauguaccaucccccaagaauuugugacacacuucguuaacgagcaggccccuacuagaggagaagcugcccuguugcacuaccuagaucccgacacccauaggaaucugggugaguuuaaacucuacccagauggcuucaugacaugcgugccuaacuccucugggacuggaccccagacccugccaauaaauggcguauuugucuucgugagcuggguuucacgguuuuaccagcuuaagccgguggguacagcagggccugcgcgccgacuguga

SEQ ID NO: 20192 - RNA, 1623 nt, Artificial Sequence
  derived and/or modified sequence opt3 from VP1__Norovirus_and/or_Norovirus-like__EF547393
augaugauggccagcaagggcgcucccaccaacauggacgggacauccggagcaggucagcuggugccugaggccaauacugcggaaccaaucucuauggagccggucgcuggcgccgcaacggccgcugcaaccgccgggcaaguuaacaugauugaucccuggauaaugaauaacuacgugcaggcuccucagggagaguucacaaucucaccaaauaacacucccggcgacauucucuuugaucuucagcuggguccucacuugaauccauucuuaagucaucuggcccaaauguauaacggguggguaggaaauaugaaagugaagguccuacucgcgggcaacgcauuuaccgccggcaaaaucauuaucagcugcauacccccuggguucguggcucagaauaucuccauugcccaggcaacaauguuuccacacguuaucgcugacgugagaguccuggaaccgauugaagugccccuugaggauguaaggaacguucuguuccauaauaacgacaauaccccuacuaugcgguugguguguaugcucuacacaccacugcgcgccucuggaucgucaagcgguaccgaucccuuugucaucgcgggccgagugcugacgugcccuaguccagacuucuccuuucucuucuuagugcccccgaacgucgagcagaagacuaaaccuuuuucuguucccaaccugccacuuaauaccuugagcaacucccgugugccuucacugauaaagaguaugaugguaagcagagaucacgggcaaauggugcaguuccagaauggaagggucacacuagacggccagcuccaagguacuacccccacaucugccucccagcuguguaagauucgggggucaguguuucaugcaaacggaggcaauggcuauaaccuuaccgaacuggaugggagcccauaccacgcuuucgagagucccgccccuaucggauucccagacuugggugaaugcgauuggcacauggaggcuucuccgacgacucaguuuaauacaggcgacguuauuaaacaaaucaacgugaagcaggaguccgccuucgcaccccaucucgggaccauccaggccgacggacugagcgaugucucggugaauacuaacaugauugcuaaauuagaauggguaucuccuguuuccgacggccacaagggugauguggacccaugggucauaccccgcuaugggucaacacugaccgaggcggcacagcucgccccuccaaucuaucccccgggcuuuggagaagcuauuguguucuuuaugagugauuucccuaucgcccauggcacgaaugggcuuagcgucccauguaccauaccccaagaguuugugacacacuucguuaacgaacaggcaccuacuagaggagaggccgcucuguugcacuaccuagaccccgauacccauaggaaucugggugaguuuaaacucuacccagacggcuucaugacaugcgugccuaacuccucugggacuggaccccagacccugccaauuaauggcguauuugucuucgugagcuggguuucacgguuuuaccagcuuaagccgguggguacagccgggccugcacgccgacuguga

SEQ ID NO: 20193 - RNA, 1623 nt, Artificial Sequence
  derived and/or modified sequence opt3 from VP1__Norovirus_and/or_Norovirus-like__AF145709
augaugauggccagcaaggacgcucccccuaacauggauggcaccuccggggcaggacagcugaucccagaggccaauacagcggaaccgauuucuauggagcccguggcuggugccgcaacugccgcugcaacggccggccaagucaacaugauagacccuuggaucaugaauaacuacguucaggcuccacagggggaguucaccauuucacccaauaacacaccuggagauauccucuuugaccuucagcugggcccacacuugaaucccuucuuaagucaucuggcccaaauguauaacgguuggguggggaauaugaaaaugaagguacuacucgcgggaaacgcauuuacugccggcaaaauuaucauaagcugcaucccuccaggcuucgcugcccagaauauuuccaucgcacaggcuaccauguuuccgcacgugauugccgaugucagagugcuggaacccaucgaaguuccucuugaggacgugaggaacguccuguuccauaauaacgauaauacaccaaccaugcgguugguguguaugcucuacacuccccugcgcgcgucugggucgucaagcggaacagacccuuuuguaauagccggucgaguucugaccugcccaagucccgauuucuccuuucucuucuuagugccgccuaacgucgagcagaagacgaaacccuuuucugugccaaaccugccucuuaauacuuugagcaacucccgugugcccucacugauuaagaguaugauggucagcagagaccacggccaaaugguucaguuccagaaugggagggugacccuagauggacagcuccaaggcacaacuccaaccucugcaucccagcuguguaagauccgggguucaguauuucaugcuaacgggggaaauggcuauaaccuuacagcccuggacggcagccccuaccacgcuuucgaaaguccugccccaauuggguucccggauuugggagagugcgacuggcacauggaagcaucucccaccacgcaguuugacacuggugaugugaucaaacaaaucaaugucaagcaggaguccgccuucgcuccucaucucggcacaauucaggcggacgggcugagcgaugugucgguuaacaccaauaugauagcaaaauuaggaugggugucuccagucuccgacggccaccgcgguaacguggaucccuggguaaucccuagauaugggucaacucugacagaggccgcucagcucgccccacccauuuacccgccuggcuuuggagaagcaaucguuuucuuuaugagugacuucagcauagcccauggcaccaaugggcuuuccgugccauguacgauuccccaagaguuugucacccacuucgugaacgaacaggcuccuacaaggggagaggccgcacuguugcacuaucuagaucccgacacucaucggaaucugggugaauuuaagcucuacccagagggcuucaugaccugcgucccuaacucuagcgggacaggaccccagacucugccaaucaauggcguguuuguuuucgugucauggguaagucgcuuuuaccagcuuaaaccggucgguaccgcggggccugcucgaagacuguga

SEQ ID NO: 20194 - RNA, 1623 nt, Artificial Sequence
  derived and/or modified sequence opt3 from VP1__Norovirus_and/or_Norovirus-like__FJ711163
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauguacucuuugaccuucagcugggcccucacuugaauccauucuuaagucaucuggcccaaauguauaacgguuggguggggaauaugaaagucaaggugcuacucgcgggaaacgcauuuaccgccggcaaaauuaucauuagcugcauacccccuggcuucgcugcccagaauuuuuccaucgcacaggcuacaauguucccacacguuaucgccgaugugagaguccuggaaccgauugaagugccccuugaggacguaaggaacguucuguuucauaauaacgauaauaccccuacuaugcgguugguguguaugcucuacacaccacugcgcgcgucugggucgucaagcggaaccgaccccuucgucaucgccggucgagugcugacgugcccuaguccagauuuuuccuuccucuuuuuagugcccccgaacgucgagcagaagacuaaaccuuucucuguucccaaccugccacuuaauaccuugagcaacucccgugugccuucacugauuaagaguaugaugaucagcagagaccacggccaaaugguacaguuucagaaugggagggugacacuagauggacagcuccaaggcacuacccccacaucugcaucccagcuguguaagauacgggguucagucuuccaugcuaacgggggaaauggcuauaaccuuaccgaacuggacggcagcccauaccacgccuucgagagucccgcuccuauuggguuuccagauuugggagaaugcgacuggcacauggaggccucuccgaucacgcaguucgacacuggugaugugauuaaacaaaucaauguuaagcaggaguccgcauuugcuccccaucucggcacagugcaggccgacgggcugagcgaugucucggcgaacaccaauaugaucgcaaaauuaggaugggugucuccuguauccgacggccaccgcucagauguugacccaugggugauucccagauaugguaguacucugacagaagccgcucagcucgccccuccaauauaucccccgggguucggcgaggcaaucgucuuuuucaugagcgauuuuccuauugcccauggaaccaacggccuuuccgugccauguacgaucccccaagaguucgucacccacuuugugaaugaacaggcuccuacaaggggagaagccgcacuguugcacuaccuagaccccgauacucaucggaaccugggggaguucaagcucuacccagacgguuuuaugaccugcguuccuaauucuagcggcacagggccccagacucugccaauaaacggaguguucguauuugucucaugggugagucgcuucuaccagcuuaaaccgguuggcaccgcggguccugcucgaagacuguga

SEQ ID NO: 20195 - RNA, 1623 nt, Artificial Sequence
  derived and/or modified sequence opt3 from VP1__Norovirus_and/or_Norovirus-like__FJ711164
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauguacucuuugaccuucagcugggcccucacuugaauccauucuuaagucaucuggcccaaauguauaacgguuggguggggaauaugaaagucaaggugcuacucgcgggaaacgcauuuaccgccggcaaaauuaucauuagcugcauacccccuggcuucguugcucagaauuuuuccaucgcccaggcaacaauguucccacacgugaucgcugaugucagagugcuggaaccgauugaaguaccccuugaggacguuaggaacgugcuguuucauaauaacgauaauaccccuacuaugcgguuggucuguaugcucuacacaccacugcgcgccgggggaucuucgucagguaccgaccccuucgugaucgcgggccgagugcugacgugcccuagcccagauuuuaguuuccucuuuuuaguucccccgaacgucgagcagaagacuaaaccuuucuccgugcccaaccugccacuuaauaccuugucuaacagccguguaccuucccugauuaagucaaugaugaucaguagagaccacgggcaaauggugcaguuucagaauggaagggucacacuagauggccagcuccaagguacuacccccacaagcgccucucagcuguguaagauacggggguccguguuccaugcaaacggaggcaauggcuauaaccuuaccgaacuggacgggucaccauaccacgcuuucgagagccccgccccuauuggauuuccagauuugggugaaugcgacuggcacauggaggcuaguccgacgacucaguucgacacaggcgauguuaucaaacaaauuaaugugaagcaggagucugccuuugcaccccaucucgggaccguccaggccgacggacuguccgaugugagcgcuaacacuaauaugaucgcgaaauuaggcuggguaucgccuguuucugacggucaccgcuccgauguggacccaugggucauccccagauaugggucaacacugaccgaagcagcccagcucgcuccuccaauuuaucccccgggcuucggagaggccauaguguuuuucaugagugauuuuccuaucgcacauggcacgaacgggcuuagcgucccauguaccauuccccaagaguucgugacacacuuuguuaaugaacaggccccuacuaggggagaagcugcccuguugcacuaccuagaccccgauacccaucggaaccugggugaguucaagcucuacccagacggcuuuaugacaugcgugccuaauuccucugggacuggaccccagacccugccaaucaacggcguauucgucuuugugagcuggguuucacgcuucuaccagcuuaaaccgguggguacagcagggccugcgcgaagacuguga

SEQ ID NO: 20196 - RNA, 1623 nt, Artificial Sequence
  derived and/or modified sequence opt3 from VP1__Norovirus_and/or_Norovirus-like__AF414405
augaugauggccagcaaggacgcucccccuaacauggauggcaccuccggggcaggacagcuggugccagaggccaauacagcggaaccgaucucuauggagcccgucgcuggugccgcaacugccgcugcaacggccggccaaguuaacaugauugacccuuggauaaugaauaacuacgugcaggcuccacagggggaguucaccaucucacccaauaacacaccuggagauauucucuuugaccuucagcugggcccacacuugaaucccuucuuaagucaucuggcccaaauguauaacgguuggguagggaauaugaaagugaagguccuacucgcgggaaacgcauuuacugccggcaaaaucauuaucagcugcauaccuccaggcuucgcugcccagaauaucuccauugcacaggcuaccauguuuccgcacgugaucgccgauguuagagugcuggaacccauugaagucccucuugaggacgugaggaacguacuguuccauaauaacgauaauacaccaaccaugcgguugguuuguaugcucuacacuccccugcgcgcgucugggucgucaagcggaacagacccuuuugugaucgccggucgaguccugaccugcccaagucccgauuucuccuuucucuucuuagugccgccuaacguggagcagaagacgaaacccuuuucugucccaaaccugccucuuaauacuuugagcaacucccguguucccucacugauaaagaguaugauggugagcagagaccacggccaaaugguacaguuccagaaugggagggugacccuagauggacagcuccaaggcacaacuccaaccucugcaucccagcuguguaagauucgggguucagucuuucaugcuaacgggggaaauggcuauaaccuuacagaacuggacggcagccccuaccacgccuucgagaguccugcuccaaucggguucccggauuugggagaaugcgacuggcacauggaggccucucccaccacgcaguuugacacuggugaugugauuaaacaaaucaauguuaagcaggaguccgcauucgccccucaucucggcacaauccaggcugggggacugagcgacgugucggucaacaccaauaugauugcgaaauuaggcugggugucuccaguauccgauggucaccgcgggaacguugaccccugggugauaccuagauauggcucaacucugacagaagcagcccagcucgcuccacccaucuacccgccuggauuuggcgaggccauugucuucuuuaugagugauuucccaaucgcacaugggaccaauggacuuagcgugcccuuuacgauaccucaagaguucgucacccacuuugugaacgaacaggcccccacaaggggugaagcugcccuguuguauuaccuagacccagauacucaccggaaucugggcgaguucaagcucuacccugagggguuuaugaccuguguucccaacuccucuggaacaggcccacagacucugccgauuaaugguguguucguauuugucagcugggugucacgcuucuaucagcuuaaaccuguugggaccgcaggccccgcgcgaagacuguga

SEQ ID NO: 20197 - RNA, 1623 nt, Artificial Sequence
  derived and/or modified sequence opt3 from VP1__Norovirus_and/or_Norovirus-like__AB022679
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaacgcgucuugaaccucacugagcuggacgggagcccauucaugggauucggugcaccggcucccgccggcuuuccugauuuagggucuugcgacuggcacauugagauguccaaaaucccaaauucaagcacacagaacaaucccauugugaccaacaguguaaagccuaauucucagcaguucguuccacaucuguccagcaucacgcucgaugaaaacgugucgucuggaggcgacuacaucgguaccauucaauggacaucucccccgucagauagugggggcgcgaauacuaacuuuuggaagauaccugacuauggaagcucccuugccgaggcaucucagcuggcuccagccgucuaucccccuggcuucaaugaagugaucgucuacuuuauggcuagcauucccgggccaaaccagucaggaaguccuaauuuggugcccugucuacugccacaggaguacaucacccacuucauauccgagcaagccccgauucagggugaagcagcccuccugcacuacguugauccugacacaaaccgaaaucuuggcgaguuuaaacuguaucccgggggauacuugacuugcgugccaaacagcuccucaaccggcccccagcagcucccucuggaugguguauucgucuuugcuaguugggugagcagauucuaucaauuaaagccaguugggacagcgggccccgcaaggggacggcuguga

SEQ ID NO: 20198 - RNA, 1623 nt, Artificial Sequence
  derived and/or modified sequence opt3 from VP1__Norovirus_and/or_Norovirus-like__AF414403
augaugauggccagcaaggacgcucccccuaacauggauggcaccuccggggcaggacagcuggugccagaggccaauacagcggaaccgaucucuauggagcccgucgcuggugccgcaacugccgcugcaacggccggccaaguuaacaugauugacccuuggauaaugaauaacuacgugcaggcuccacagggggaguucaccaucucacccaauaacacaccuggagauauucucuuugaccuucagcugggcccacacuugaaucccuucuuaagucaucuggcccaaauguauaacgguuggguagggaauaugaaagugaagguccuacucgcgggaaacgcauuuacugccggcaaaaucauuaucagcugcauaccuccaggcuucgcugcccagaauaucuccauugcacaggcuaccauguuuccgcacgugaucgccgauguuagagugcuggaacccauugaagucccucuugaggacgugaggaacguacuguuccauaauaacgauaauacaccaaccaugcgguugguuuguaugcucuacacuccccugcgcgcgucugggucgucaagcggaacagacccuuuugugaucgccggucgaguccugaccugcccaagucccgauuucucccucuuauuucuggugccgccuaacguggagcagaagacgaaacccuucucugucccaaaccuuccuuugaauacucugagcaacucccguguucccucacuaauaaagaguaugauggugagcagagaccacggccaaaugguacaguuucagaaugggaggguggcacucgauggacagcugcaaggcaccacaccaacuucugcuucccagcuuuguaagauucgggguucagucuuccaugccaacgggggaaauggcuauaaccccaccgaacuggacggcagcccuuaccacgcuuuugagaguccagccccgaucggguuccccgauuugggagaaugcgacuggcacauggaggcaucuccuacaacccaguucgacacgggugaugugauuaaacaaaucaauguuaagcaggaguccgccuuugcuccacaucucggcacuauccaggcggacgggcugagcgaugugucggucaacacaaauaugauugcaaaauuaggaugggugucucccguauccgacggccaccgcgguaacguugauccuugggugauaccaagauaugggucaacccugacugaagccgcucagcucgcacccccgaucuacccuccaggcuucggagaggccauugucuuuuucaugagugacuuucccaucgcccauggcacaaaugggcuuagcgugccuuguaccauaccccaagaguucgucacgcacuuugugaacgaacaggcuccaaccaggggagaagccgcacuguugcacuaucuagauccugacacacaucggaaucugggugaguucaagcucuaccccgagggcuuuaugacuugcguuccaaacuccucugggaccggaccgcagacacugccuauuaauggcguguucguauuugucagcugggugucacgcuucuaccagcuuaaacccguugguacugcggggccagcucgaagacuguga

SEQ ID NO: 20199 - RNA, 1623 nt, Artificial Sequence
  derived and/or modified sequence opt3 from VP1__Norovirus_and/or_Norovirus-like__LC101821
augaugauggccagcaaggacgcugcacccuccgccgauggcgcgaccggggcuggacagcuggugccugaggucaacacagccgacccaaucccgauugaucccguugcagguucuucaacugcccucgcuacggcaggccaagugaaucuuauagacccuuggaucauuaacaauuucguacaggccccacagggggaauuuaccaucagucccaacaauacaccuggagaugugcuguucgacuugcaguuaggcccacaccugaaccccuuucuaagccaucucucccaaauguacaaugguugggucgggaacaugagagugaggguugugcuggcuggaaaugccuucacugcgggcaaagucauuaucugcugugugccuccaggcuuucagucucggacccuuucgauagcacaggccacacuguucccgcacguaaucgcugauguucgcaccuuggaccccguggaggucccucucgaagaugugcgaaacgugcuguaucauaauaacgacacucagccaacaaugcgucugcucugcauguuauacacgccccugagaaccgggggagccucagguggcacugauagcuuugucguugcagggagggugcuuaccuguccuggaccagacuucaacuuuuuguuccugguacccccgacaguggagcaaaagacucggccuuuuaccguccccaauauuccacuaaaauaucucaguaauucccgcaucccuaaccccauugaaggcaugucucugagcccagaucagacacagaacgugcaguuccaaaaugguagaugcaccaucgacgggcagccccuuggaacgacuccuguuuccgugucacagcuguguaaguuuaggggccggauaacaaguggccaaaaagucuugaaccucaccgagcuggacgggagcccauucauggcuuucgccgcgccggcccccgugggauuuccugauuuagguucuugcgacuggcacauugagauguccaagaucccaaauucaagcacucagaguaaccccauuguaguuaauucugugaagccuaacucccagcaguucgucccacaucugagcucgaucacacucgaugacaaugugucuuccggcggggauuacaucggaaccauucaauggacgucacccccgaguggcagcgguggggcaaacaccaauuuuuggaaaauaccugacuauggcuccucucuugcugaagccagccagcuggcuccagccgucuaucccccuggauucaacgaggugaucguuuacuuuauggcaucaauucccggcccaaaucagaguggguccccuaacuuggugcccugucuacugccacaggaauacaucacacacuucauaagcgagcaagccccgauucagggagaggcugcgcuccugcacuacguagauccugacacuaaucgcaaccuuggugaauuuaagcuguaucccggcggguacuugaccugcgucccaaauucuucaaguacaggaccccagcagcucccucuggauggcguguucguuuuugcaagcugggugucccgauucuaucaauuaaaaccagucgguacugccgggcccgcuagaggcaggcuguga

SEQ ID NO: 20200 - RNA, 1623 nt, Artificial Sequence
  derived and/or modified sequence opt3 from VP1__Norovirus_and/or_Norovirus-like__AY038598
augaugauggccagcaaggacgcucccccuaacauggauggcaccuccggggcaggacagcuggugccagaggccaauacagcggaaccgaucucuauggagcccgucgcuggugccgcaacugccgcugcaacggccggccaaguuaacaugauugacccuuggauaauggauaauuacgugcaggcuccacagggggaguucaccaucucacccaacaauacaccuggagacauucucuuugaucuucagcugggcccacacuugaaccccuucuuaagucaucuggcccaaauguauaaugguuggguagggaacaugaaagugaagguccuacucgcgggaaaugcauuuacugccggcaaaaucauuaucagcugcauaccuccaggcuucgcugcccagaacaucuccauugcacaggcuaccauguuuccgcacgugaucgccgacguuagagugcuggaucccauugaagucccucuugaagacguggggaauguacuguuccauaacaauggagauacaccaaccaugagguugguuuguaugcucuacacuccccugcgggcgucugguucgucaagcggcacagacccuuuugugaucgccgggcacguccugaccugcccaagucccgauuucuccuuucucuucuuaggaccgccuaacguggagcagaagacgaaacccuuuucugugccaaaucugccucuuaacacuuugagcaacucccgcguccccucacugauacgaaguaugaugguuagccgugaccauggccaaauggugcaguuccagaaugguagaguaacccuagaugggcagcuccaaggaacaacuccaaccucugcaucccagcuguguaagauuaggggcucaguguuucacgcuaacggcgggaauggauauacacuuaccgagcuggacgguagccccuaccacgccuucgaaaguccugcuccaaucggcuucccggacuugggggagugcgauuggcauauggaagccucucccacgacucaguuugacacaggagaugucauuaagcaaaucaacgugaaacaggaggcagccuucgcuccucaccucggcaccauccaggcggacggucuguccgauguuagcgugaauacuaacaugauugcaaaguuagggugggucucgccagccucugacggccaucggggaaauguggaucccuggguaauaccucgcuauggcuccacacugaccgaggcugcccagcucgcaccacccaucuacccgccuggguuuggagaagccauuguuuucuuuaugucagacuucccaaucgcucacggugccaacggccuuagugugcccuguacgauaccucaagaguuugucacccacuucgugaaugaacaggcacccacaagaggggaggcggcucuguugcauuaucuagauccagacacucacaggaaccugggagaauuuaaacucuacccugagggcuucaugaccugcguccccaauagcuccgguacagggccacagacucugccgauuaacggcguguuuguuuucgugucuuggguaagccgguuuuaccagcuuaagccugucggaaccgccggccccgcacgcucacuguga

SEQ ID NO: 20201 - RNA, 1623 nt, Artificial Sequence
  derived and/or modified sequence opt3 from VP1__Norovirus_and/or_Norovirus-like__KJ196292
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauauucucuuugaccuucagcugggcccucacuugaauccauucuuaagucaucuggcccaaauguauaacgguuggguagggaauaugaaagugaagguccuacucgcgggaaacgcauuuaccgccggcaaaaucauuaucagcugcauacccccuggcuucguggcucagaauguuuccaucgcccaggcaacaauguuuccacacgugauugcugaugucagagugcuggaaccgaucgaaguaccccuugaggacguuaggaacgugcuguuccauaauaacgauaauaccccuacuaugcgguuggucuguaugcucuacacaccacugcgcgccucugggucgucaagcggaaccgaccccuuugugauugcgggucgagugcugacgugcccuaguccagauuucuccuuucucuucuuaguucccccgaacgucgagcagaagacuaaaccuuuuucugugcccaaccugccacuuaauaccuugagcaacucccguguaccuucacugaucaagaguaugauggugagcagagaccacggccaaaugguccaguuccagaaugggagggugacacuagauggacagcuccaaggcacuacccccacaucugccucccagcuguguaagauacgggguucaguuuuucaugcaaacgggggaaauggcuauaaccuuaccgaacuggacggcagcccauaccacgcuuucgagagucccgccccuauuggguucccagauuugggagaaugcgacuggcacauggaggcuucuccgacgacucaguuuaauacaggugacgugaucaaacaaauuaacgucaagcaggaguccgccuucgcaccccaucucggcaccauccaggccgaugggcugagcgacgugucgguaaauacuaacaugaucgcuaaauuaggauggguuucuccuguguccgauggccacaagggugacgucgauccaugggugauuccccgcuaugggucaacacugaccgaagcggcacagcucgccccuccaauauaucccccgggcuuuggagaggcuaucgucuucuuuaugagugacuucccuauugcccauggcacgaaugggcuuagcgugccauguaccaucccccaagaauuuguuacacacuucgugaacgagcaggcaccuacuagaggagaagccgcucuguugcacuaccuagaucccgacacccauaggaaucugggugaguuuaaacucuacccagauggcuucaugacaugcguaccuaacuccucugggacuggaccccagacccugccaauaaauggcgucuuuguguucguuagcugggugucacgguuuuaccagcuuaagccggucgguacagccgggccugcacgccgacuguga

SEQ ID NO: 20202 - RNA, 1623 nt, Artificial Sequence
  derived and/or modified sequence opt3 from VP1__Norovirus_and/or_Norovirus-like__JQ743331
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaaaaagucuugaaccucacugagcuggacgggagcccauucauggcauucgcugccccggcgcccgccggauuuccugauuuagguucuugcgacuggcacauugagauguccaagaucccaaauucaagcacacagaguaaccccauugugguaaauucuguuaagccuaacucccagcaguucgugccacaucugagcucgaucacccucgaugacaaugucucuuccggcggggauuacaucggaacgauucaauggaccucacccccgagugacagcggcggugcaaacacaaauuuuuggaaaauaccugauuauggguccucucuugcugaagccagccagcuggcuccagccguguaucccccuggcuucaacgaggucaucguguacuuuauggcaucaauucccggaccaaaucagaguggcuccccuaacuugguucccugucuacugccacaggaauacaucacucacuucauaagcgagcaagccccgauucagggggaggcugcgcuccugcacuacguggacccugauaccaaucgcaaccuuggagaauuuaagcuguaucccgguggcuacuugacaugcguaccaaauucuucaaguacugggccccagcagcucccucuggacggagucuucguguuugcaagcuggguuucccgauucuaucaauuaaaaccagugggcaccgccggucccgcuagagggaggcuguga

SEQ ID NO: 20203 - RNA, 1623 nt, Artificial Sequence
  derived and/or modified sequence opt3 from VP1__Norovirus_and/or_Norovirus-like__EF547394
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaaaaagucuugaaccucacugagcuggacgggagcccauucauggcauucgcugccccggcgcccgccggauuuccugauuuagguucuugcgacuggcacauugagguguccaagaucccaaauucaagcacacagaguaaccccauuguaguuaauucugugaagccuaacucccagcaguucgucccacaucugagcucgaucacccucgaugacaaugugucuuccggcggggauuacaucggaacgauucaauggaccucacccccgagugacagcggcggugcaaacacaaauuuuuggaaaauaccugauuauggguccucucuugcugaagccagccagcuggcuccagccgucuaucccccuggcuucaacgaggugaucguuuacuuuauggcaucaauucccggaccaaaucagaguggcuccccuaacuuggugcccugucuacugccacaggaauacaucacucacuucauaagcgagcaagccccgauucagggggaggcugcgcuccugcacuacguagacccugauaccaaucgcaaccuuggagaauuuaagcuguaucccgguggcuacuugacaugcgucccaaauucuucaaguacugggccccagcagcucccucuggacggaguguucguuuuugcaagcugggugucccgauucuaucaauuaaaaccagucggcaccgccggucccgcuagagggaggcuguga

SEQ ID NO: 20204 - RNA, 1623 nt, Artificial Sequence
  derived and/or modified sequence opt3 from VP1__Norovirus_and/or_Norovirus-like__AF394960
augaugauggccagcaaggacgcuacccccuccgcagauggcgccacaggggcgggacagcuggugccugaggucaacacugcugguccaaucccgauugaccccguugccgggucuucaacggcacucgccaccgcuggccaagugaaucuuauagauccuuggaucauuaacaauuucguacaggcaccacagggagaauuuacaaucagucccaacaauacuccuggcgacgugcuguucgauuugcaguuagguccacaccugaaccccuuucuaagccaucucucccaaauguacaaugggugggucggaaacaugagagugaggguugugcuggccggcaaugcuuucaccgccggcaaagucauuaucugcugugugccuccaggguuucagucucggacacuuucgauagcgcaggcaacccuguucccgcacguaaucgccgacguucgcacuuuggaucccguggaggucccucucgaagacgugcgaaacgugcuguaucauaauaacgauacacagccaaccaugcgucugcucugcauguuauacacgccccugagaacuggaggugcuucaggcgggaccgacagcuuugucguugccggaagggugcuuacauguccuggcccagauuucaacuuuuuguuccugguacccccgacuguggagcaaaagacccggccuuuuacaguccccaauauuccacuaaaauaucucaguaauucccgcaucccuaaccccauugaagguaugucucugagcccagaccagacccagaacgugcaguuccaaaaugggagaugcacgaucgauggacagccccuuggcacuacaccuguuuccgugucacagcuguguaaguuuaggggccggauaaccagugggcaaaaagucuugaaccucacugagcuggacggaagcccauucauggcauucgcugccccggcgcccgccgguuuuccugacuuaggcucuugcgauuggcacauugagauguccaagaucccaaauucaagcacacagaguaaccccauugugguaaauucuguuaagccuaacucccagcaguucgugccacaucugagcucgaucacccucgacgauaaugucucuuccgggggagacuacaucggcacgauucaauggaccucacccccgagugauagcgguggggcaaacacaaauuuuuggaaaauaccugacuauggcuccucucuugcugaagccagccagcuggcuccagccguguaucccccuggauucaacgaggucaucguguacuuuauggcaucaauucccggcccaaaucagaguggguccccuaacuugguucccugucuacugccacaggaauacaucacucacuucauaagcgagcaagccccgauucagggagaggcugcgcuccugcacuacguggauccugacaccaaucgcaaccuuggugaauuuaagcuguaucccggcggguacuugacaugcguaccaaauucuucaaguacuggaccccagcagcucccucuggauggcgucuucguguuugcaagcuggguuucccgauucuaucaauuaaaaccaguggguaccgccgggcccgcuagaggcaggcuguga

SEQ ID NO: 20205 - RNA, 1623 nt, Artificial Sequence
  derived and/or modified sequence opt3 from VP1__Norovirus_and/or_Norovirus-like__AJ277616
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaaaaagucuugaaccucacuaagcuggacgggagcccauucauggcauucgcugccccggcgcccgccggauuuccuaauuuagguucuugcgauuggcacauugagauguccaagaucccaaacucaagcacacagaguaaucccauugugguaaacucuguuaaaccuaauucccagcaguucgugccacaucugagcucgaucacccucgacgagaacgucucuuccggcggggauuacaucggaacgauucaauggaccucacccccgagugacagcggcggugcaaauacaaacuuuuggaagauaccugauuauggguccucucuugcugaagccagccagcuggcuccagccguguaccccuuggucuucaaugaggugaucguuuauuuuauggcauguauucgcggcccuaaccagugcggaucacccaaucuagugccaugucugaguccucaggaauacaucacucacuucauauccgagcaagcccccauucagggcgaggcugcgcuccugcacuacguagacccagauaccaaccgaaaucuuggggaauuuaaacuguauccgggagguuacuugacaugcgucccuaacucuagcucaacuggcccccagcagcucccacuggacgggguguucguuuuugcaaguugggugagcagauucuaucaauuaaagcccgucggaaccgccggcccugcuaggggucggcuguga

SEQ ID NO: 20206 - RNA, 1623 nt, Artificial Sequence
  derived and/or modified sequence opt3 from VP1__Norovirus_and/or_Norovirus-like__GQ413970
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaacgcgucuugaaccucacugagcuggacgggagcccauucauggcauucgcugccccggcgcccgccggauuuccugauuuagguucuugcgacuggcacauugagauguccaaaaucccaaauucaagcacacagaacaaucccauugugguaaacaguguuaagccuaauucucagcaguucgugccacaucuguccagcaucacccucgaugacaacgucucgucuggcggggauuacaucggaacgauucaauggaccucucccccgucagacaguggcggugcaaauacaaacuuuuggaagauaccugauuaugggagcucccuugcugaagccucucagcuggcuccagccguguaucccccuggcuucaaugaggucaucguguacuuuauggcaagcauucccggaccaaaccagucaggcaguccuaauuugguucccugucuacugccacaggaauacaucacucacuucauauccgagcaagccccgauucagggggaggcugcgcuccugcacuacguggacccugauaccaaccgaaaucuuggagaauuuaaacuguaucccgguggcuacuugacaugcguaccaaacagcuccucaacugggccccagcagcucccucuggacggagucuucguguuugcaaguuggguuagcagauucuaucaauuaaagccagugggcaccgccggucccgcuagggggcggcuguga

SEQ ID NO: 20207 - RNA, 1623 nt, Artificial Sequence
  derived and/or modified sequence opt3 from VP1__Norovirus_and/or_Norovirus-like__KT732281
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaaaaagucuugaaccucacugagcuggacgggagcccauucauggcauucgcugccccggcgcccgccggauuuccugauuuagguucuugcgacuggcacauugagguguccaagaucccaaauucaagcacacagggcaaccccauuguaguuaauagugugaagccuaacucucagcaguucgucccacaucuguccagcaucacccucgaugacaaugugucgucugggggagauuacaucggcacgauucaauggaccucucccccgucagacagugguggggcaaacacaaauuuuuggaaaauaccugauuauggcagcucccuugcugaagccucucagcuggcuccagccgucuaucccccuggauucaacgaggugaucguuuacuuuauggcaagcauucccggcccaaaucagucagggaguccuaacuuggugcccugucuacugccacaggaauacaucacucacuucauauccgagcaagccccgauucagggagaggcugcgcuccugcacuacguagacccugauaccaaucgcaaccuuggugaauuuaagcuguaucccggcggguacuugacaugcgucccaaauagcuccucaacuggaccccagcagcucccucuggacggcguguucguuuuugcaaguugggugagccgauucuaucaauuaaaaccagucgguaccgccgggcccgcuagaggcaggcuguga

SEQ ID NO: 20208 - RNA, 1623 nt, Artificial Sequence
  derived and/or modified sequence opt3 from VP1__Norovirus_and/or_Norovirus-like__AF414404
augaugauggccagcaaggacgcuacccccuccgcagauggcgccacaggggcgggacagcuggugccugaggucaacacugcugacccaaucccgauugaucccguugccgguucuucaacggcacucgccaccgcuggcagagugaaucuuauagacccuuggaucauuaacaauuucguacaagcaccacagggggaauuuacaaucagucccaacaauacuccuggagaugugcuguucgacuugcaguuaggcccacaccugaaccccuuucuaagccaucucucccagauguacaaugguugggucgggaacaugagggugcggguugugcuggccggaaaugcuuucaccgccggcaaagucauuaucugcugugugccuccaggcuuucaaucucgcacacuuucgauagcgcaggcaacccuguucccgcacguaaucgccgauguucgaacuuuggaccccguggaggucccucucgaagaugugcguaacgugcugcaucacaauaacgacacacagccaaccaugagacugcucugcauguuauauacgccccugaggacugggggagcuucagguggcaccgauagcuuugucguuagugggcgggugcuuacauguccuggaccagacuucaacuuuuuguuccugguacccccgacuguggagcagaagacccgcccuuuuacaguccccaauauuccacuaaaaugccucuccaauucuagaaucccuaaccccauugaaggcaugagccuguccccagaucaaacccagaacgugcaguuccagaaugguagguguacgaucgacgggcaaccccuuggaacuacaccuguuucagugagucagcugugcaaguuucggggccgcauaaccagcggccagggggucuugaaccucacugagcuggacggaucuccauucauggccuucgcagcuccggcccccgcggguuuuccugauuuaggcuccugugacuggcauauugagaugucaaaaaucccaaauagcaguacacaaaacaaucccauugugguaaacucuguuaagccuaauucccagcaguucgugccacaccugagcucgaucacccucgaugaaaacgucucuuccgggggagacuacaucggcacgauucaguggaccucacccccgagugauagcgguggggccaauacaaacuuuuggaagauaccugacuauggcuccucucuugcagaggcuagccaacuggccccagcuguguaucccccuggauucaaugaagucaucguguacuuuauggccucaauucccggcccaaaccagaguggguccccuaauuugguucccugccuacugccacaggaguacaucacucacuucauaagcgagcaggcaccgauucaaggagaagccgcucuccugcauuauguggauccugacaccaaccgaaaucuuggugaguuuaaacuguaccccggcggguacuugacauguguaccaaacucuucaaguacuggaccccagcagcucccucuggauggcgucuucguguuugcgagcuggguuuccagauucuaucaguuaaagccaguggguaccgcagggcccgccaggggccggcuguga

SEQ ID NO: 20209 - RNA, 1623 nt, Artificial Sequence
  derived and/or modified sequence opt3 from VP1__Norovirus_and/or_Norovirus-like__AF414402
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugccgggugccuccaggcuuucagucucgcacacuuucgauagcgcaggcaacccuguucccgcacguaaucgccgauguucgaacuuuggaccccguggaggucccucucgaagaugugcguaacgugcuguaucauaauaacgacacacagccaaccaugagacugcucuguauguuauacacgccccugaggacugggggagcuucagguggcaccgauagcuuugucguuguggggcggguacuuacaugcccuggaccagacuucaacuuuuuguuccuggugcccccgacugucgagcaaaagacccgcccuuuuacagcccccaauauuccacuaaaauaucucaguaauuccagaaucccuaaccccauugaaggcaugucucugagcccagaucagacccagaacgugcaguuccaaaaugguagguguacgaucgacgggcagccccuuggagcaacuccuguuuccgugucacagcugugcaaguuucggggccgcauaacaaguggccaacgagcuuugaaccucaccgagcuggacgggagcccauucauggccuucgcggccccggcacccgcuggauuuccugauuuagguucuugugacuggcacauugagauguccaaaaucccaaauucaagcacucagaacaaucccauugucgugaacaguguaaagccuaauucucagcaguucguuccacaucugcccuccaucacacucgaugaaaacgugagcucgggcggggacuacaucggaaccauucaauggacgucuccgccuuccgauucaggcggugccaauaccaacuuuuggaagauaccagacuaugggaguagccuugcugaggccucccagcuggcacccgccgucuacccucccggcuucaaugaagugaucgucuauuuuauggcuucuauuccaggaccuaaccagagcggcucacccaauuuggugccaugccuacugccgcaggaguacaucacacacuucauaagugagcaagcgccuauucagggggaagcagcccuccugcacuacguugaucccgacacuaacagaaaucuuggagaguuuaaacuguauccagguggcuacuugaccugugugcccaacuccagcucuacagggccucagcagcucccacuggauggaguauucgucuuugcuucaugggugaguagguucuaucaauuaaagcccguuggcacugccgguccugcacgggggcgucuguga

SEQ ID NO: 20210 - RNA, 1623 nt, Artificial Sequence
  derived and/or modified sequence opt3 from VP1__Norovirus_and/or_Norovirus-like__AJ313030
augaugauggccagcaaggacgcuacccccuccgcagauggcgcccugggggcgggacagcucgugccugaggucaacacagcugacccaaucccgauugaucccguugccgguucuucaacugcacuugccacggcuggccaagugaaucugauagacccuuggaucauuaacaauuucguacaggcaccacagggggaauuuaccaucagucccaacaauacaccuggagauguguuguucgacuuacagcugggcccacaccuaaaccccuuucucagccaucugucccaaauguacaaugguugggucgggaacaugagagugaggguugugcuugccggaaaugcuuucacugccggcaaagucauuaucugcugugugccuccaggcuuucagucucggacccugucgauagcgcaggcaacauuguucccgcacguaaucgccgauguucgcacccucgaccccguggaggucccucuggaagaugugcgaaacgugcuguaucauaauaacgacacucagccaacaaugcgucucuuaugcaugcuguacacgccccuuagaaccgggggagcuucagguggcacugauagcuuugucguugccgggaggguguugaccuguccuggaccagacuucaauuuucuguuccuaguacccccgacaguggagcaaaagacucggccuuuuaccguccccaacauuccacucaaauaucugaguaauucccgcaucccuaaccccauugaaggcaugucucuuagcccagaucagacacagaacgugcaguuccaauccgguagaugcaccaucgacgggcagccccugggaacgacuccuguuucagugagucaguuguguaaguuuaggggccggauaacaagcggccaaaaaguccucaaucugaccggguuagacggaucuccauucauggcauucgcugccccggcgcccgccgguuuuccugaucugggcuccugcgacuggcacauugagaugucaaagaucccaaacagcaguacucagaauaaccccauugugaucaauucuguaaagccuaacucccagcaguucguuccacaucucagcucgaucacacuugaugagaaugugcugucugggggagacuacauuggcaccauacaauggacgucucccccgucagauagugguggggcaaacaccaauuuuuggaaaaucccugacuauggcagcuccuuggcugaagccucucagcuagcuccagccgucuaucccccuggauucaacgaggugauugucuacuuuauggcaagcauccccggcccaaaucagucagggaguccuaaccuggugcccugucuccugccacaggaauacauaacacacuucauuuccgagcaagccccgauccagggagaggcugcgcuucugcacuacguugauccugacacuaaucgcaacuugggugaauuuaagcucuaucccggcggguaccugaccugcgugccaaauagcuccucaacaggaccccagcaguuaccucuggauggcguauucgucuuugcaaguugggugagccgauucuaucaacuaaaaccaguugguacuagagggcccgccaggggccggcucuga

SEQ ID NO: 20211 - RNA, 1623 nt, Artificial Sequence
  derived and/or modified sequence opt3 from VP1__Norovirus_and/or_Norovirus-like__KM036381
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaaaaagucuugaaccucacugagcuggacgggagcccauucauggcauucgcugccccggcgcccgccggauuuccugauuuagguucuugcgacuggcacauugagauguccaagaucccaaauucaagcacagaaaguaaccccauugugguaaauucuguuaagccuaacucccagcaguucgugccacaucugagcucgaucacccucgaugacaaugucucuuccggcggggauuacaucggaacgauucaguggaccucacccccgagugacagcggcggugcaaacacaaauuuuuggaaaauaccuaacuauggguccucucuugcugaggccagccaacuggcuccagccguguaucccccuggcuucaaugaagucaucguguacuuuauggcaucaauucccggaccaaaccagaguggcuccccuaauuugguucccugucuacugccacaggaguacaucacucacuucauaagcgagcaggccccgauucaaggggaagcugcgcuccugcacuacguggauccugacaccaaccgcaaucuuggagaguuuaagcuguaucccgguggcuacuugacaugcguaccaaacucuucaaguacugggccccagcagcucccucuggauggagucuucguguuugcaagcuggguuucccgauucuaucaguuaaaaccagugggcaccgccggucccgcuagagggaggcuguga

SEQ ID NO: 20212 - RNA, 1623 nt, Artificial Sequence
  derived and/or modified sequence opt3 from VP1__Norovirus_and/or_Norovirus-like__LN854563
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaacgcgucuugaaccucacugagcuggacgggagcccauucauggcauucgcugccccggcgcccgccggauuuccugauuuagguucuugcgacuggcacauugagauguccaaaaucccaaauucaagcacacagaacaaucccauugugguaaacaguguuaagccuaauucucagcaguucgugccacaucuguccagcaucacccucgaugacaucgucucgucuggcggggauuacauuggaacgauacaauggaccucacccccguccgacaguggcggugcaaacacaaauuuuuggaagaucccugauuaugggagcucccuuucugaagcuagccagcuggccccagcuguguaucccccuggcuucaacgaggucauuguguacuuuauggccucaauccccggaccaaaucagaguggcuccccuaacuugguucccugucuacugccacaggaauacauaacucacuucauuagcgagcaagcaccgauccagggggaggccgcucuccugcacuacguggacccugauaccaaucgaaaccuuggagaauuuaaacuguaucccgguggcuacuugacaugcguaccaaauucuucaaguacugggccccagcagcucccucuggacggagucuucguguuugcgagcuggguuuccagauucuaucaauuaaagccagugggcaccgcaggucccgccagggggcggcuguga

SEQ ID NO: 20213 - RNA, 1623 nt, Artificial Sequence
  derived and/or modified sequence opt3 from VP1__Norovirus_and/or_Norovirus-like__AB042808
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaacgcgucuugaaccucacugagcuggacgggagcccauucauggcauucgcugccccggcgcccgccggauuuccugauuuagguucuugcgacuggcacauugagauguccaaaaucccaaauucaagcacacagaacaaucccauugugaccaacaguguaaagccuaauucucagcaguucguuccacaucuguccagcaucacgcucgaugaaaacgugucgucuggcggggacuacaucggaaccauucaauggacaucucccccgucagauaguggcggugcaaauacuaacuuuuggaagauaccugacuaugggagcucccuugcugaggccucucagcuggcuccagccgucuaucccccuggcuucaaugaagugaucgucuacuuuauggcaagcauucccggaccaaaccagucaggcaguccuaauuuggugcccugucuacugccacaggaguacaucacccacuucauauccgagcaagccccgauucagggggaagcugcgcuccugcacuacguugauccugacacaaaccgaaaucuuggagaguuuaaacuguaucccgguggcuacuugacuugcgugccaaacagcuccucaaccgggccccagcagcucccucuggauggaguauucgucuuugcaaguugggugagcagauucuaucaauuaaagccaguuggcacagccggucccgcuagggggcggcuguga

SEQ ID NO: 20214 - RNA, 1623 nt, Artificial Sequence
  derived and/or modified sequence opt3 from VP1__Norovirus_and/or_Norovirus-like__EU004679
augagaaugagcgacggcgccgcucccaaggcaaacggguccgaggccucuggacaggaucuggugccuaccgcgaucgaacaagcugucccaauucagccgguugccgguucagcacucgccgcucccgcagccggccagauaaaucagaucgacccuuggauuuuccaaaacuuugugcagugcccacuuggggaguucaguaucagccccaggaauacaccuggagaaauucuguuugauuuggcuuuaggcccaggucugaaccccuaccuagcccaccucuccgcgauguauacuggguggguaggaaauauggaggugcagcugguccuugcaggcaacgccuucacggcuggcaaagugguuguggcccuggucccuccauacuuuccgaaggggucuuugaccacagcacagaucacuuguuucccccaugugaugugcgacguacggacccucgaaccuauacaacugccacugcucgauguucgccgaguguuauggcacgcuacacaggaccaggaggagucgaugcgucuggucuguaugcuuuauacccccuugagaacuaauucaccuggagaugagagcuuuguggugagugguaggcugcuauccaaaccagccgcggacuucaacuuugucuaccucacacccccgaucgaacggaccauuuaucgcaugguugaucugccugugcuucagcccagacugugcacgcaugccagguggccagcaccuaucuacggcuugcucguagaccccucucugccaagcaauccccaauggcagaacgggcgggugcacgucgauggaacuuuacugggcaccacaccuguguccgguucauggguuaguuguuucgcugccgaagcugccuaugaguuucagagcgggacuggagagguggcaaccuucacacucauugaacaagacggcucugccuacgucccaggcgaucgcgcugcgccgcuuggguaccccgacuuuuccggacagcuggagaucgaagugcagaccgagacgacuaagacaggugacaaauugaagguaaccacuuucgaaaugauacuaggcccuacaaccaauguugaucaggcaccauaucaagggaagguguacgccucacuggcugucgccgcaagccucgaccugguggauggacgagucagagccgugcccaggaguauuuauggcuuccaggacguuaucccugaguacaacgauggucuucuggugccauuggcucccccgauugggccuuuucucccaggcgagauccuguuacgguuccguacguauaugcgccagcuggacaccgccgaugcagcggcugaagccaucgacugcgcacuaccccaggaguuuauuucuugguucgccuccaaugcuuuuacaguacaagccgaugcacuccugcuuagauacaggaacacuuugaccggacagcuccuguucgaauguaaacuguauagcgagggcuacauagcucuuucguacucuggguccgccccucugacauuucccacugacggauucuuugaagucgugucauggguuccacgguuguuccagcucgcgaguguggguagccugaccacaggccgaaccuuaaaguga

SEQ ID NO: 20215 - RNA, 1623 nt, Artificial Sequence
  derived and/or modified sequence opt3 from VP1__Norovirus_and/or_Norovirus-like__EU004678
augagaaugagcgacggcgccgcucccaaggcaaacggguccgaggccucuggacaggaucuggugccuaccgcggucgaacaagcuguuccaauccagccgguggccgguucagcacucgccgcucccgcagccggccagauuaaucagauagacccuuggaucuuccaaaacuuuguacagugcccacuuggggaguucaguauuagccccaggaauacaccuggagaaauccuguuugauuuggcuuuaggcccaggucugaaccccuaccuagcccaccucuccgcgauguauacugggugggugggaaauauggagguccagcuggugcuugcaggcaacgccuucacggcuggcaaaguuguggucgcccuggugccuccauacuuuccgaaggggucuuugaccacagcacagauuacuuguuucccccauguaaugugcgacguucggacccucgaaccuauccaacugccacugcucgaugugcgccgagucuuauggcacgcuacacaggaccaggaggagucgaugcgucugguguguaugcuuuauacccccuugagaacuaauucaccuggagaugagagcuuuguggucagugguaggcugcuauccaaaccagccgcggacuucaacuuuguuuaccucacacccccgauagaacggaccaucuaucgcaugguggaucugccuguacuucagcccagacugugcacgcaugccagguggccagcaccuauuuacggcuugcucguggaccccucucugccaagcaauccccaauggcagaacgggcggguccacguggauggaacuuuacugggcaccacaccuguuuccgguucaugggugaguuguuucgcugccgaagcugccuaugaguuucagagcgggacuggagaggucgcaaccuucacacucaucgaacaagacggcucugccuacgugccaggcgaucgcgcugcgccgcuuggguaccccgacuuuuccggacagcuggagauugaaguacagaccgagacgacuaagacaggugacaaauugaagguuaccacuuucgaaaugauccuaggcccuacaaccaauguggaucaggcaccauaucaagggcgagucuacgccucacugacggcuguggccagccucgaccuggucgauggaagagugagggcaguuccccggaguauauauggcuuccaggacgugauuccugaguacaacgauggucuucugguaccauuggcucccccgaucgggccuuuucucccaggcgagguccuguuacguuuccgcaccuauaugagacagcuggacacagccgaugccgcagcggaagcuauugacugcgcccuaccccaggaguuuaucucuugguucgcauccaaugccuuuacugugcaaagcgaugcucuccugcuuagguaccggaacaccuugacaggacagcuccuguucgaauguaagcuguauucggagggcuacaucgcccuuucuuacuccgggucaggaccucugacuuuucccaccgacgguuucuuugaaguugugaguugggucccacgauuguuccagcucgcaagcgugggcucccugacaaccgggcgcacuuuaaaauga

SEQ ID NO: 20216 - RNA, 1623 nt, Artificial Sequence
  derived and/or modified sequence opt3 from VP1__Norovirus_and/or_Norovirus-like__AB281085
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaaugucaccaucacgaacuuaaaugguucacccuucgacccuagugaagauauuccagcuccgcugggggugcccgacuuccagggaaggguauuuggcguuaucagccaacgggauaagcacauagccucuggccauaacgagccugcuaaucgcgggcacgacgccguggucccaacuuacacagcacaguacacccccaaacucggacagauucaaaucgguacuuggcagacagaugaccuuaccgugaaccagccugucaaguucacgccagugggccugaaugauaccgaccauuuuaaccaguggguugugccccgauaugccggggcuuugaaucuaaacacaaaucuggcgccguccguagcaccugucuucccaggagaaagacuccuguuuuucaggucauacauuccccuuaaaggcgguuaugggaacccugccaucgauugccuguugccccaagagugggugcagcacuuuuaccaggagagcgcuccaaguaugucugaaguugcccucgugcgguauaucaauccugacacuggccgugcacuguucgaggccaaguuacaccgcgcuggauuuaugaccgucuccagcaacacaucggcccccgugguagugccagcaaacggcuacuucagauuugauucuuggguuaaucaguucuauucccuggcgccgauggggacuggaaacgguaggcggcgauga

SEQ ID NO: 20217 - RNA, 1623 nt, Artificial Sequence
  derived and/or modified sequence opt3 from VP1__Norovirus_and/or_Norovirus-like__AB662868
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaacaccuguauaaugucaccaucauuaacuuaaaugguagucccuucgacccuagcgaggacaucccagcaccgcugggggugcccgauuuccagggaaggguauuuggcguuauaucucaacgggacaagcacaacacgccuggccauaaugaaccagcuaaccgcgcccacgaugcugugguccccacuuacacagcccaguacaccccuaaacucgggcagauucaaaucggaacuuggcagacagacgaucuuaccaauaaccagccagugaaguucacgcccgucggucugaaugacaccgagcauuuugaucagugggugguuccgcgauaugcaggcgccuugaaccuaaauacaaaccuggcuccuuccguggcgccaguauuccccggggagagacuccuguuuuucaggucauacauuccucuuaaaggaggcuaugguacucccgcaaucgacugccuguugccacaagaauggguccagcacuuuuaccaggaggccgcuccuagcaugagugaaguggcccucguucgguauaucaaucccgauaccgggcgugcacuguucgaggccaaguuacaccgcgcuggcuuuaugacagugucuuccaacacuagcgccccagucgugguaccggcaaacggauacuucagauuugacucgugggugaaucaguucuauucucuggcgccuaugggcaccgggaacggaaggcggcgauga

SEQ ID NO: 20218 - RNA, 1623 nt, Artificial Sequence
  derived and/or modified sequence opt3 from VP1__Norovirus_and/or_Norovirus-like__AB662861
augaagauggccagcaacgacgcugugcccuccaccgauggcgcagccgggcuggucccugagucuaauaacgaaguuauggcgcucgagccaguggcuggagccgcacuugccgcuccgguaacaggucagacuaauaucauugaccccuggauaagagcaaacuucgugcaagccccuaauggcgaauuuacggucucaccaaggaacagucccggggaggugcuguugaauuuagaacugggaccugagcuaaacccauaccucgcucaccuggcccggauguauaauggcuacgcgggugggauggagguucaggugaugcuugcaggaaacgccuucaccgcuggcaaacuggucuuugccgcagugcccccucauuucccaguagaaaauuugagcccgcagcagaucacaauguuuccccacguuauuaucgaugugcgcacucucgagccuguccugcugccacuccccgacgugcgaaacaauuucuuucauuauaaccaaaaggaugacccuaaaaugcguauuguggcuauguuauacaccccacugagauccaauggcucuggggaugacgucuucacaguuucgugcagggugcuuacccggcccucaccggauuuugacuucacuuauuugguaccucccacaguggaaagcaagaccaaaccauuuacgcugccuauccuaacucucggagagcugaguaacucccgcuuccccgucucuauagaucagauguacaccagcccaaacgaggugaucuccguucagugucagaaugguagaugcacacuugacggcgaacugcaagggacuacccagcuccaggugucaggaauuugugccuuuaagggcgaggucacagcgcacuugcaugauaacgaacaccuguauaaugugaccaucacgaacuuaaaugguagucccuucgacccuagcgaggacauuccagccccgcuggggguacccgauuuccagggaaggguuuuuggcgugaucucucaacgggacaagcacaacacuccuggccauaaugaaccagcaaaccgcgcucacgaugccgucgugcccacauacaccgcucaguacacuccuaaacucgggcagguccaaauaggaacauggcagaccgacgaucuuacggacaaucagccagugaaguucacccccguuggucugaacgauacagagcauuuuaaucagugggugguaccgcgauaugccggcgcauugaaccuaaauacuaaccuggccccuuccgucgcuccaguguuccccggggagagacuccuguuuuucaggucauacauuccucuuaaaggaggcuaugguacccccgcgaucgacugccuguugccacaagaauggguucagcacuuuuaccaggaggcagccccuagcaugagugaaguggcucucguccgguauauuaaucccgauacagggcgugcccuguucgaggcaaaguuacaccgcgccggcuuuaugacugugucuuccaacaccagcgcuccaguagugguuccggccaacggauacuucagauuugacucgugggucaaucaguucuauucucuggcaccuaugggcacagggaacggaaggcggcgauga

SEQ ID NO: 20219 - RNA, 1623 nt, Artificial Sequence
  derived and/or modified sequence opt3 from VP1__Norovirus_and/or_Norovirus-like__LC145791
augaagauggccagcaacgacguggcucccuccaccgauggcgcagccgggcuggucccugagucuaauaacgaaguuauggcgcucgagccaguggcuggagccgcacuugccgcuccgguaacaggucagacuaauaucauugaccccuggauaagagcaaacuucgugcaagccccuaauggcgaauuuacggucucaccaaggaacagucccggggaggugcuguugaauuuagaacugggaccugagcuaaacccauaccucgcucaccuggcccggauguauaauggcuacgcgggugggauggagguucaggugaugcuugcaggaaacgccuucaccgcuggcaaacuggucuuugccgcagugcccccucauuucccaguagaaaauuugagcccgcagcagaucacaauguuuccccacguuauuaucgaugugcgcacucucgagccuguccugcugccacuccccgacgugcgaaacaauuucuuucauuauaaccaaaaggaugacccuaaaaugcguauuguggcuauguuauacaccccacugagauccaauggcucuggggaugacgucuucacaguuucgugcagggugcuuacccggcccucaccggauuuugacuucacuuauuugguaccucccacaguggaaagcaagaccaaaccauuuacgcugccuauccuaacucucggagagcugaguaacucccgcuuccccgucucuauagaucagauguacaccagcccaaacgaggugaucuccguucagugucagaaugguagaugcacacuugacggcgaacugcaagggacuacccagcuccaggugucaggaauuugugccuuuaagggcgaggucacagcgcacuugcaugauaacgaccaccuguauaaugugaccaucacgaacuuaaaugguagucccuucgacccuagcgaagauauuccagccccgcuggggguacccgacuuccagggaaggguuuuuggcgugaucucucaacgggauaagcacaacacuccuggccauaaugagccagcaaaccgcgcucacgacgccgucgugcccacauacaccgcucaguacacuccuaaacucgggcagauacaaauuggaacauggcagaccgaugaccuuacggucaaucagccagugaaguucacccccguuggucugaacgauacagaccauuuuaaucagugggugguaccgcgauaugccggcgcauugaaccuaaauacuaaccuggccccuuccgucgcuccaguguuccccggggaaagacuccuguuuuucaggucauacaucccucuuaaaggaggcuaugguacccccgcgauugauugccuguugccacaagaguggguucagcacuuuuaccaggaggcagccccuagcaugagugaaguggcucucguccgguauaucaaucccgacacagggcgugcccuguucgaggcaaaguuacaccgcgccggcuuuaugacugugucuuccaacaccagcgcuccaguagugguuccggccaacggauacuucagauuugauucgugggucaaucaguucuauucucuggcaccuaugggcacagggaacggaaggcggcgauga

SEQ ID NO: 20220 - RNA, 1623 nt, Artificial Sequence
  derived and/or modified sequence opt3 from VP1__Norovirus_and/or_Norovirus-like__LC145790
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaaguucacccccgugggucugaacgauacagaccauuuuaaucaguggguugugccgcgauaugcaggcgccuugaaccuaaauacuaaccuggcuccuuccguagcgccagucuuccccggggaaagacuccuguuuuucaggucauacaucccucuuaaaggaggcuaugguacccccgcaauugauugccuguugccacaagagugggugcagcacuuuuaccaggaggccgcuccuagcaugagugaaguugcccucgugcgguauaucaaucccgacacagggcgugcacuguucgaggccaaguuacaccgcgcuggcuuuaugacugucucuuccaacaccagcgccccagugguagugccggcaaacggauacuucagauuugauucguggguuaaucaguucuauucucuggcgccuaugggcacagggaacggaaggcggcgauga

SEQ ID NO: 20221 - RNA, 1623 nt, Artificial Sequence
  derived and/or modified sequence opt3 from VP1__Norovirus_and/or_Norovirus-like__LC145793
augaagauggccagcaacgacgcugcacccuccaccgauggcgccgcggggcuggugccugagucuaauaacgaagucauggcucucgagccaguugccggaguggcacuugccgcuccgguaacaggucagacuaauaucauugaccccuggauaagagcaaacuucgugcaagccccuaauggcgaauuuacggucucaccaaggaacagucccggggaggugcuguugaauuuagaacugggaccugagcuaaacccauaccucgcucaccuggcccggauguauaauggcuacgcgggugggauggagguucaggugaugcuugcaggaaacgccuucaccgcuggcaaacuggucuuugccgcagugcccccucauuucccaguagaaaauuugagcccgcagcagaucacaauguuuccccacguuauuaucgaugugcgcacucucgagccuguccugcugccacuccccgacgugcgaaacaauuucuuucauuauaaccaaaaggaugacccuaaaaugcguauuguggcuauguuauacaccccacugagauccaauggcucuggggaugacgucuucacaguuucgugcagggugcuuacccggcccucaccggauuuugacuucacuuauuugguaccucccacaguggaaagcaagaccaaaccauuuacgcugccuauccuaacucucggagagcugaguaacucccgcuuccccgucucuauagaucagauguacaccagcccaaacgaggugaucuccguucagugucagaaugguagaugcacacuugacggcgaacugcaagggacuacccagcuccaggugucaggaauuugugccuuugagggcgaagucacagcgcacuugcaugauaacgaccaccuguauaaugugaccaucacgaacuuaaaugguagucccuucgacccuagcgaggauauuccagccccgcuggggguacccgacuuccagggaaggguuuuuggcgugaucucucaacgggauaagcacaacacuccuggccauaaugaaccagcaaaccgcgcucacgacgccgucgugcccacauacaccgcucaguacacuccuaagcucgggcagauacaaauuggaacauggcagaccgaugaccuuacggucaaucagccagugaaauucacccccguuggucugaacgauacagaccauuuuaaucagugggugguaccgcgauaugccggcgcauugaaccuaaauacuaaccuggccccuuccgucgcuccaguguuccccggggagagacuccuguuuuucaggucauacaucccucuuaagggaggcuaugguacccccgcgauugauugccuguugccacaagaguggguucagcacuuuuaccaggaagcagccccuagcaugagugagguggcucucguccgguauaucaaucccgacacagggcgugcccuguucgaagcaaaauuacaccgcgccggcuuuaugacugugucuuccaacaccagcgcuccaguagugguuccggccaacggauacuucagauuugauucgugggucaaucaguucuauucucuggcaccuaugggcacagggaacggaaggcggcgauga

SEQ ID NO: 20222 - RNA, 1623 nt, Artificial Sequence
  derived and/or modified sequence opt3 from VP1__Norovirus_and/or_Norovirus-like__LC145792
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaaguucacccccgugggucugaacgauacagaccauuuuaaucaguggguuuugccgcgauaugcaggcgcccuaaaccugaauacuaaccucgcuccuuccguggcgccaguauuccccggggaaagacugcuguuuuucaggucauacaucccucuuaaaggaggcuaugguacccccgcaauugauugcuugcucccacaagaguggguccagcacuuuuaccaggaggccgcuccuagcaugagugaaguggcccugguucgguauaucaaucccgacacagggcgugcauuauucgaggccaagcugcaccgcgcuggcuuuaugacugugucuuccaacaccagcgccccagucgugguaccggcaaacggauacuucagauuugauucgugggugaaucaguucuauucucuagcgccuaugggcacagggaacggaaggcggcgauga

SEQ ID NO: 20223 - RNA, 1623 nt, Artificial Sequence
  derived and/or modified sequence opt3 from VP1__Norovirus_and/or_Norovirus-like__LC145797
augaagauggccagcaacgacgcugcacccuccaccgauggcgccgcggggcuggugccugagucuaauaacgaagucauggcucucgagccaguugccggaguggcacuugccgcuccgguaacaggucagacuaauaucauugaccccuggauaagagcaaacuucgugccugccccaaauggcgaauuuacggucucacccaggaacaguccuggggaggugcuguugaauuuagaacugggaccagagcuaaaccccuaccucgcucaccuggcccggauguauaauggcuacgcgggugggauggagguucaagugaugcuugcaggaaacgccuucaccgcuggcaaacuggucuuugccgcagugccuccacauuucccgguagaaaauuugagcccccagcagaucacaauguuuccucacguuauuaucgaugugcgcacucucgagccaguccugcugccccucccugacgugcgaaacaauuucuuucauuauaaccagaaggaugacccaaaaaugcguauuguggcuauguuauacacaccccugagauccaauggcucuggggaugacgucuucaccguuucgugcagggugcuuacccggccgucaccugauuuugacuucacuuauuugguacccccaacaguggaaagcaagaccaaacuguuuacgcuaccuauccucacucugggagagcuuaguaacucccgcuuccccgucucuauagaucaaauguacaccagcccaaacgaggugaucuccguucagugucagaaugguagaugcacacuggacggcgaauugcaggggacuacccaacuccaggugucaggaauuugugccuuuaagggcgaggucacagcgcaccuucaugauaacgaccacuuauauaaugugaccaucacgaaccugaaugguagucccuucgacccuagcgaagauauuccagccccgcucgggguacccgacuuccagggaaggguuuuuggcgugaucucucagcgggauaagcacaacauauccggccauaaugagccugcaaaccgcgcucacgacgccgucgugccaacuuacacagcucaauacacccccaaacuugggcagauucagaucggaacuuggcaaacagaugaccugaccgucaaucagccugugaaguucacgccaguugguuugaacgauaccgaccauuuuaaucagugggugguaccccgauaugccggcgcacuaaaccugaauacaaaccucgccccgucagucgcuccuguguucccaggggaaagacugcuguuuuucaggagcuacauuccccugaaaggaggcuaugguacuccugcgaucgauugcuugcucccccaggaguggguucaacacuuuuaccaggaggcagccccaaguaugucugaaguggcucugguccgguauaucaauccugacaccgggcgugccuuauucgaggcaaagcugcaccgcgccggcuuuaugacaguguccagcaacacuucggcucccguagugguuccagccaacggauacuucagauuugauucuugggucaaucaguucuauucccuagcaccgaugggcaccgggaacggaaggcggcgauga

SEQ ID NO: 20224 - RNA, 1623 nt, Artificial Sequence
  derived and/or modified sequence opt3 from VP1__Norovirus_and/or_Norovirus-like__LC145808
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacgcuccuggccauaaugagccagccaaccgcgcucacgacgccgugguccccacuuacacagcacaguacaccccuaaacucgggcagauacaaauuggaacuuggcagacagaugaccuuaccgugaaucagccagucaaguucacgcccgugggucugaacgauaccgaccauuuuaaucaguggguugugccgcgauaugccggcgcuuugaaccuaaauacaaaccuggcgccuuccguagcaccagucuuccccggggaaagacuccuguuuuucaggucauacaucccucuuaaaggaggcuaugguacucccgccauugauugccuguugccacaagagugggugcagcacuuuuaccaggaggcugccccuagcaugagugaaguugcacucgugcgguauaucaaucccgacaccgggcgugcccuguucgaggcuaaguuacaccgcgccggcuuuaugacagucucuuccaacacuagcgcaccagugguagugccggcgaacggauacuucagauuugauucguggguuaaucaguucuauucucuggcuccuaugggcaccgggaacggaaggcggcgauga

SEQ ID NO: 20225 - RNA, 1623 nt, Artificial Sequence
  derived and/or modified sequence opt3 from VP1__Norovirus_and/or_Norovirus-like__LC145801
augaagauggccagcaacgacgcugcacccuccaccgauggcgccgcggggcuggugccugagucuacaaaugaagucauggcucucgagccaguugccggagcagcccuugcugcaccggugacuggucagacgaacaucauugaccccuggauaagagccaauuucguacaagcuccuaacggcgaauuuaccgugucaccaaggaauagucccggggagguccuguugaacuuagaacugggaccugagcuaaauccauaccucgcccaccuggcgcggauguauaacggcuacgccggugggauggaggugcagguuaugcuugcaggaaaugcuuucacagccggcaaacugguguuugcagcugugcccccucauuucccagucgaaaacuugagcccgcagcagaucacuauguuuccccacguaauuaucgauguucgcacccucgagccugugcugcugccacuccccgacguccgaaauaacuucuuucauuauaaucaaaaggaugacccuaaaaugcguauuguggccauguuauacacaccacugagauccaacggcucuggggaugacguguucaccgucucgugcaggguucuuacucggcccucaccggauuuugacuucacauauuuggugccucccaccguagaaagcaagacgaaaccauuuacucugccuauccuaacccucggagagcugaguaauucccgcuuccccgugucuauagaucagauguacacaagcccaaacgaggucaucuccgugcagugucagaacgguagaugcacucuugacggcgaacugcaagggaccacacaguugcagguuucaggaauuugugcguuuaagggcgaggugaccgcccaccuccaugauaaugaccaccuguauaacgucacgaucacuaauuuaaacgguagucccuucgacccuagcgaagauauuccagcaccgcugggggcucccgacuuccagggaaggguguuuggcguaaucucucaacgggauaagcacaauacaccuggccauaacgagccagccaaucgcgcucacgacgccguugugcccaccuacacugcacaguacacaccuaaacucgggcagauacaaauuggaaccuggcagacggaugaccuuaccgucaaccagccagugaaguucacacccgucggucugaaugauacugaccauuuuaaccagugggugguuccgcgauaugccggcgcuuugaaucuaaacaccaaucuggcgccuuccguggcaccaguauuccccggggaaagacuccuguuuuucaggucauacaucccucuuaaaggaggcuaugguacacccgccauugauugccuguugccacaagaguggguccagcacuuuuaccaggaggcugccccuagcaugagugaaguggcacucguucgguauaucaaccccgacacugggcgugcccuguucgaggcuaaguuacaccgcgccggcuuuaugaccgugucuuccaauacaagcgcaccagucgugguaccggcgaacggauacuucagauuugauucgugggugaaccaguucuauucucuggcuccuaugggcaccgggaauggaaggcggcgauga

SEQ ID NO: 20226 - RNA, 1623 nt, Artificial Sequence
  derived and/or modified sequence opt3 from VP1__Norovirus_and/or_Norovirus-like__AB662884
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaacuucacccccgugggucuguccgauacagaccauuuuaaucaguggguugugccgcgauaugcaggcgccuugaaccuaaauacuaaccuggcuccuucaguagcgccagucuuccccggggaaagacuccuguuuuucaggagcuacaucccucuuaagggaggcuaugguacccccgcaauugauugccuguugccacaagagugggugcagcacuuuuaccaggaggccgcuccuaguaugucugaaguugcccucgugcgguauaucaaucccgacacagggcgugcacuguucgaggccaaauuacaccgcgcuggcuuuaugacugucuccagcaacaccucggccccagugguagugccggcaaacggauacuucagauuugauucuuggguuaaucaguucuauucccuggcgccuaugggcacagggaacggaaggcggcgauga

SEQ ID NO: 20227 - RNA, 1623 nt, Artificial Sequence
  derived and/or modified sequence opt3 from VP1__Norovirus_and/or_Norovirus-like__LC145802
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggccaugccggugggauggaggugcagguuaugcuugcaggaaacgcuuucaccgccggcaaacugguguuugcagcugugcccccucacuucccagucgaaaauuugagcccgcagcagaucacaauguuuccccauguaauuaucgauguucgcacucucgagccugugcugcugccacuccccgacguccgaaacaauuucuuucacuacaaccaaaaggaugacccuaaaaugcguauuguggccauguuauauaccccacugagauccaauggcucuggggaugacguguucacagucucgugcaggguucuuacccggcccucaccggauuuugaguucacuuacuuggugccucccacaguagaaagcaagaccaaaccauuuacgcugccuauccuaacucucggagagcugaguaacucccgcuuccccgugucuauagaccagauguauaccagcccaaacgaagucaucuccgugcagugucagaaugguagaugcacacuugauggcgagcugcaagggacuacccaguugcaggcgucaggaauuugugccuuuaagggcgaaguuacagcacaucuccacgacaacgaucaccuguacaaugugaccaucacgaacuuaaaugguagucccuucgacccuagcgaggacauuccagcuccgcuggggguccccgauuuccagggaaggguguuuggcguaaucucucaacgggacaagcauaacgccccuggccacaaugaaccagcuaaccgcgcccaugaugcaguugugcccacuuauacagcccaguacaccccuaaacucgggcagauacaaauuggaacuuggcagacagacgaucuuaccgucaaucagccagugaaguucacgcccgucggucugaacgacaccgaucacuuugaccagugggugguuccgcgauacgcuggcgcguugaaucuaaacacaaaucuggcaccuuccguggccccaguauuccccggggagagacuccuguuuuucaggucauauaucccucuuaaaggaggcuacgguacucccgcuauugauugccuguugccacaagaguggguccagcacuuuuaucaggaagccgcaccuagcaugagugagguggcccucguucgguacaucaaccccgacaccgggcgugcucuguucgaagccaaguuacaucgcgcaggcuuuaugacagugucuuccaauacuagcgcgccagucgugguaccggcuaacggauauuucagauuugauucgugggugaaccaguucuacucucuggccccuaugggcaccgggaauggaaggcggcgauga

SEQ ID NO: 20228 - RNA, 1623 nt, Artificial Sequence
  derived and/or modified sequence opt3 from VP1__Norovirus_and/or_Norovirus-like__AB662897
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaaguucacccccgugggucugaacgauacagaccauuuuaaucaguggguugugccgcgauaugcaggcgccuugaaccuaaauacuaaccuggcuccuuccguagcgccagucuuccccggggaaagacuccuguuuuucaggucauacaucccucuuaaaggaggcuaugguaccagcgcaauugauugccuguugccccaagagugggugcagcacuuuuaccaggaggccgcuccaaguaugucugaaguugcccucgugcgguauaucaauccugacacagggcgugcacuguucgaggccaaguuacaccgcgcuggcuuuaugacugucuccagcaacaccucggcccccgugguagugccagcaaacggauacuucagauuugauucuuggguuaaucaguucuauucccuggcgccgaugggcacagggaacggaaggcggcgauga

SEQ ID NO: 20229 - RNA, 1623 nt, Artificial Sequence
  derived and/or modified sequence opt3 from VP1__Norovirus_and/or_Norovirus-like__AB662899
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaacuucacccccgugggucugaaugauacagaccauuuuaaccaguggguugugccgcgauaugcaggcgccuugaaucuaaacacuaaucuggcuccuuccguagcgccagucuuccccggggaaagacuccuguuuuucaggucauacaucccucuuaagggaggcuaugguacccccgcaauugauugccuguugccacaagagugggugcagcacuuuuaccaggaggccgcuccuagcaugagugaaguugcccucgugcgguauaucaaccccgacacagggcgugcacuguucgaggccaaauuacaccgcgcuggcuuuaugacugucucuuccaacaccagcgccccagugguagugccggcaaauggauacuucagauuugauucguggguuaaccaguucuauucucuggcgccuaugggcacagggaauggaaggcggcgauga

SEQ ID NO: 20230 - RNA, 1623 nt, Artificial Sequence
  derived and/or modified sequence opt3 from VP1__Norovirus_and/or_Norovirus-like__AB662894
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagcaaacuucacccccgucggucuguccgauacagaccauuuuaaucagugggugguuccgcgauaugccggcgcuuugaaccuaaauacuaaccuggcgccuucaguggcaccaguauuccccggggaaagacuccuguuuuucaggagcuacaucccucuuaagggaggcuaugguacccccgccauugauugccuguugccacaagaguggguccagcacuuuuaccaggaggcugccccuaguaugucugaaguggcacucguucgguauaucaaucccgacacagggcgugcccuguucgaggcuaaauuacaccgcgccggcuuuaugacuguguccagcaacaccucggcaccagucgugguaccggcgaacggauacuucagauuugauucuugggugaaucaguucuauucccuggcuccuaugggcacagggaacggaaggcggcgauga

SEQ ID NO: 20231 - RNA, 1623 nt, Artificial Sequence
  derived and/or modified sequence opt3 from VP1__Norovirus_and/or_Norovirus-like__LC145803
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguaguagcuucgaccccucugaagauauuccugcaccacuggggaucccggacuuccagggaaggguguuuggcguaauaucccaacgggauaagcacaacacucccggccauaaugagccugcuaaccgcgcccacgacgcuguugugccaacauacaccgcccaguacacucccaaacucgggcagauucaaaucggaacauggcagaccgaugaccuuacggucaaucagccugugaaguucaccccagucggucugaacgauacagaccauuuuaaucagugggugguuccccgauaugcaggcgccuugaaccuaaauacuaaccuggcuccgucaguggcgccuguauucccaggggaaagacuccuguuuuucaggagcuacauuccccuuaaaggaggcuaugguaccccugcaaucgauugccuguugccccaagaguggguccagcacuuuuaccaggaggccgcuccaaguaugucugaaguggcccucguucgguauaucaauccugacacagggcgugcacuguucgaggccaaguuacaccgcgcuggcuuuaugacuguguccagcaacaccucggcccccgucgugguaccagcaaacggauacuucagauuugauucuugggugaaucaguucuauucccuggcgccgaugggcacagggaacggaaggcggcgauga

SEQ ID NO: 20232 - RNA, 1623 nt, Artificial Sequence
  derived and/or modified sequence opt3 from VP1__Norovirus_and/or_Norovirus-like__AB662889
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaaguuuuacgcugccaauccuaacucucggagagcuguccaacucucgcuucccugugagcauagaucagauguacaccucccccaacgaggucaucucagugcagugucagaaugguagaugcacacuugacggcgaacugcaagggacuacccaguugcagguuaguggaauuugugcguuuaagggcgaggugacagcccaccuccaugauaacgaccaccuguauaaugucaccaucacgaacuuaaaugguagcccauucgaccccucugaagauauuccugcaccacugggggugccggacuuccagggaaggguauuuggcguuaucucccaacgggauaagcacaacacucccggccauaaugagccugcuaaccgcgcccacgacgcuguggucccaacauacaccgcccaguacacucccaaacucgggcagauacaaauuggaacauggcagaccgaugaccuuacggugaaucagccugucaacuucaccccagugggucugucagauacagaccauuuuaaucaguggguugugccccgauaugcaggcgccuugaaccuaaauacuaaccuggcuccgagcguagcgccugucuucccaggggaaagacuccuguuuuucaggaguuacaucccccuuaagggaggcuaugguaccccugcaauugauugccuguugccccaagagugggugcagcacuuuuaccaggaggccgcuccaucuauguccgaaguugcccucgugcgguauaucaauccugacacagggcgugcacuguucgaggccaaauuacaccgcgcuggcuuuaugacugucagcucgaacaccucugcccccgugguagugccagcaaacggauacuucagauuugauuccuggguuaaucaguucuauucacuggcgccgaugggcacagggaacggaaggcggcgauga

SEQ ID NO: 20233 - RNA, 1623 nt, Artificial Sequence
  derived and/or modified sequence opt3 from VP1__Norovirus_and/or_Norovirus-like__AB662876
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaacuucacccccgcaggucuguccgauacagaccauuuuaaucagugggugguuccgcgauaugccggcgcuuugaaccuaaauacuaaccuggcgccuucaguggcaccaguauuccccggggaaagacuccuguuuuucaggagcuacaucccucuuaagggaggcuaugguacccccgccauugauugccuguugccacaagaguggguccagcacuuuuaccaggaggcugccccuaguaugucugaaguggcacucguucgguauaucaaucccgacacagggcgugcccuguucgaggcuaaauuacaccgcgccggcuuuaugacuguguccagcaacaccucggcaccagucgugguaccggcgaacggauacuucagauuugauucuugggugaaucaguucuauucccuggcuccuaugggcacagggaacggaaggcggcgauga

SEQ ID NO: 20234 - RNA, 1620 nt, Artificial Sequence
  derived and/or modified sequence opt3 from VP1__Norovirus_and/or_Norovirus-like__KU555841
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcucugaugcaccaggguccacucgggcucaacaggccugggugucaacauauagcccccaguucguaccuaaacuaggaaguguuaaucugcguauaucugacaacgaugacuuucaguuccaaccaaccaaguuuacgcccgugggugucaaugaugacgauggccacccguuccgccagugggaacucccuaacuacuccggggagcugacccuuaauaugaaccuggcuccacccguggccccuaauuuucccggagaacagcucuuguucuuuaggagcuucgucccaugcucgggcgguuacaaccaggggauuaucgacugucugauuccucaagaguggauccagcauuuuuaucaggaaucugcacccucccagucagauguggccuuaaucagauacguuaacccagacacaggccggacucuguucgaggcuaagcuacaccgaaguggauauauuaccguggcgcacagcggcgauuacccgcucguagucccugcaaaugggcauuuucgcuucgacuccugggugaaccaauucuauucucuggcccccaugggaacagguaauggcagaaggcgggcucaguga

SEQ ID NO: 20235 - RNA, 1620 nt, Artificial Sequence
  derived and/or modified sequence opt3 from VP1__Norovirus_and/or_Norovirus-like__GQ856468
augaagauggccagcaacgacgcugcacccuccaaugauggcgccaccgggcuggugccugagaucaacacagaaacucucccacuugagccggucgcgggagcugccauugcagcccccguuacgggucagaauaacauaaucgacccuuggauuagaaauaacuucgugcaagcuccaaauggcgaauuuaccguaucucccaggaacucaccuggggagauccugaugaauuuggaauuaggaccagaucugaaccccuaccuagcacaccucagucggauguauaauggcuacgccggugggguggagguccaggugcugcuugcuggaaacgccuucacagcgggcaaaauucuguuugcagccguuccuccaaauuucccgguggacauguugagccccgcucagaucacuaugcucccucaucugauagucgaugugcgcacccuggagccaaucaugauuccccucccugacguacgaaacguguuuuaucacuucaauaaccagccagcaccccguaugagauuaguugccaugcuguacacaccgcuuagguccaacggcucuggggaugacgucuuuaccgugucgugccggguguugacucgcccuacacccgauuucgaauuuaccuaucuggucccaccuucaguugagagcaagacgaaacccuucacucuaccaauccucaccauuggagaacugacaaauaguagauuucccgcuccuaucgaccaacuuuacacuuccccaaacgccgauauagugguacagccgcagaaugguagguguacccuggacggcgaguugcaggggacaacccaacuccugacgacugcgauuugcucuuaucggggaaugacaagcaaccccaccuccgauuacugggacgaccauuuacugcaccucgugcauccuaauggcgccacuuacgauccaacagaggacguccccgcaccuuucgguacccaggauuuucgcgggauccuuuauggaaugcugacgcagaacccacgaaccucaggcgacgaagcugccaauagucacggcauuuacaucagcucuacauccgagaaguucacucccaaauuggggaccaucggacuacaccaggugcaagguagacauucacagcaccagcaaagcaaguucacaccgguuggcauugcugugaacgggaauacuccuuuuaggcagugggaacugccaaacuauaguggagcccucacccugaauacaaaccuugcacccgccgucggcccuaauuuccccggugagcagauacuguuuuuccggucuaacgugccauccguacaagggggccagccuaucgaaauugauuguuugaucccccaggaguggguuagccauuuuuaccaggagucggcuccaucucaguccgacguggcgcucguccguuaugugaauccggauaccggacgcacuauauucgaagcaaagcugcacagacaaggcuuuauuacgaucgccgcuacagggucaaacccugucgugguucccccaaacggauacuucagguuugacaguugggugaaucaguucuaugccuuagcacccauggguaccggcaacgggcggcgacgcguacaguga

SEQ ID NO: 20236 - RNA, 1620 nt, Artificial Sequence
  derived and/or modified sequence opt3 from VP1__Norovirus_and/or_Norovirus-like__AB684681
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauaauaaccagccagcaaaccguaugagacugguugcuaugcuuuacacacccuugagguccaaugggucuggagacgauguguucaccgucucgugccgggugcugacucgcccgacaccugacuuugaguucaccuaucuagugcccccaucagucgaaagcaagacgaaaccuuuuagucuccccauucugacucuuuccgagcugaccaacucuagauucccagcccccaucgauagcuuguuuacagcgcaaaauaacguucuccaggugcagugucagaaugguaggugcacucuggacggcgaguuacaagggaccacacagcugcucccuaccggaauuugugccuuccggggccgcguaacggcagaaacugauaacccagacaaguggcauaugcagcuucagaaucugaacgguacaaccuacgauccgacugacgacgugcccgcuccuuuggggacaccagauuuccgaggacuacuguuuggcgucgccucccaaagaaaugugggcaacgacgcucccgggucaaccagggcccacgagguugugaucaguacgaccagcccucaguucgucccaaaacucggaucuauaaauuuucgguccacaucagaagauuuccguacuggucagcccacccgcuuuacaccggugggcauuaacgacgaggauaaucauccuuucaaccaaugggaacugccagacuauagcgggagacuuacucugaauaugaacuuggcacccccuguagcccccaacuuuccaggagagcagcuccuguucuuuaggaguaauguuccuugcucuggcgguuacaaccaggggaucauugauuguuuaaucccccaggaguggauccaacacuucuaccaggaauccgcuccaagccagucggagguggcgcugauucgguaugucaauccggacaccggccgaacacuauuugaagcaaagcuccaccgcaccggauacauaacuguggcccauucuggcgauuauccucuggucgugcccgcuaacggguacuucagauuugacuccuggguuaaucaguucuauucacuugccccaaugggaacggguaacggcaggcggcgcgcacaauga

SEQ ID NO: 20237 - RNA, 1620 nt, Artificial Sequence
  derived and/or modified sequence opt3 from VP1__Norovirus_and/or_Norovirus-like__AB809988
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcggggucaggacgcuuucauugauugucuccugccccaggaaugggucaaucacuuuuaccaagaggccgcaccaucccaggccgacguggcuuuaauccguuauguuaacccugauacagggcgcacucuguucgaagccaaacuacacagaucaggcuuuauaaccgugagucauacaggagcauacccccucguagucccaccgaacggccacuucagguuugacagcugggugaaucaguucuauucccuggcgccuauggggaccggaaacggucggcgauga

SEQ ID NO: 20238 - RNA, 1620 nt, Artificial Sequence
  derived and/or modified sequence opt3 from VP1__Norovirus_and/or_Norovirus-like__AB810011
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaaccgaggggauaauugggaccagaaccuguuacagcugaccuacccgagcggagcaucuuacgaucccacggacgaggucccugcuccacucggcacucaagacuucuccgguauccuuuauggggugcugacacaggauaauguuucagaaggaaccggcgaggccaagaacgcuaaaggcguguacaucagcacuacaagugggaaguuuacccccaagauuggaucuauagguuugcauuccaucacggaaaauguccacccuaaccagcaaagcagauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuaggucgcgggucccuugcgugcagggcuugcguggucaggacgcuuucauugauugucuccugccccaggaaugggucaaucacuuuuaccaagaggccgcaccaucucaggccgacguggcuuuaauccgcuauguuaacccugauacagggagaacucuguucgaagccaaacuacacagguccggcuuuauaaccgugucacauacaggagcauacccccucguagucccaccgaacggccacuuccgguuugacaguugggugaaucaguucuauagccuggcgccuauggggaccggaaacggucgacgcuga

SEQ ID NO: 20239 - RNA, 1620 nt, Artificial Sequence
  derived and/or modified sequence opt3 from VP1__Norovirus_and/or_Norovirus-like__AB809994
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcagcggcaggacgcuuucauugauugucuccugccccaagaaugggucaaucacuuuuaccaggaggccgcaccaucccaggccgacguggcuuuaauccguuauguuaacccugauacaggucgcacucuguucgaagccaaacuacacagaucaggguuuauaaccgugagucauacaggcgcauacccccucguagucccaccgaacggacacuucagguuugacagcugggugaaucaguucuauucccuggcgccuaugggcaccgggaacggacggcgauga

SEQ ID NO: 20240 - RNA, 1620 nt, Artificial Sequence
  derived and/or modified sequence opt3 from VP1__Norovirus_and/or_Norovirus-like__KX767083
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucuauccccguguuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccacaacuacaccaugaaucucgcaucucagaacuggaacuccuaugaucccacggaggaaauuccugcuccacuggguacucccgacuucguggggaagauccagggaguccuuacacagaccacucgggccgacggcucaacacgcggccauaaggcuaccguguacacggggagcgccgauuuugcaccuaagcugggacgaguccaauucgguaccgacacaaguaaugauuuugaggccaaucagaacacuaaauucaccccagugggcguuauucaggacggggauacaacucacagaaaugaaccccaacaguggguguugccgucuuacuccggaaggaacacccacaauguacaucucgcuccugcggucgcaccaacauuucccggcgagcagcuguuauucuuucggagcaccaugccugguuguucgggguaucccaacauggaccuggauugccuccuuccacaggaaugggugcaacacuucuaccaggaggccgcuccugcccagucugacguugcacuguugcguuuugugaaucccgauacuggccgcguccuauucgaguguaagcugcauaaaccaggauaugugacgguagcccacacaggccagcacgaccucgugaucccgccuaacggguacuuuagauucgauuccuggguuaaccaauucuauacccuggcucccaugggaaaugguacuggcaggcggcgagucuga

SEQ ID NO: 20241 - RNA, 1620 nt, Artificial Sequence
  derived and/or modified sequence opt3 from VP1__Norovirus_and/or_Norovirus-like__LN854565
augaagauggccagcaacgacgcuaaucccuccgauggcucugcagccaaccuggugccugaggucaauaacgaaguuauggcgcucgagccagugguaggggcugccaucgcagccccgguggcuggacagcaaaauaucauagaccccuggaucagaaacaauuucguccaggcaccugguggcgaauuuaccgugucaccaaggaacgcccccggggagauucuuuggagugcuccucugggaccagauuugaaucccuacuuaagccaccuggcccggauguauaacggcuacgcggguggguucgaaguucaggugauccuagcaggaaaugccuuuacagcuggcaaaauuaucuucgccgcagucccuccaaacuuuccgacugagggccucucccccucucaggugacgauguucccucauauaaucguagacguucgccaacuggagccagugcuuauuccccugccugauguccgaaauaacuuuuaucacuacaaucagucgaacgacucaaccaucaaguugauugcuaugcucuauacaccacugcgugccaacaaugcgggggaugacguguucacugugagcugcagaguccugaccaggcccaguccggauuuugacuucaucuuucucguuccucccacaguggaaucccggaccaaaccauucacuauaccuauuuuaacaguagaggaaaugaccaacucucgcuuucccaucccacuggagaaacuuuacacgggacccagcuccgccuucgugguccagccucagaaugguagauguacuaccgauggcguguugcuggggacaacucaacuaucaccaguuaacauuugcaccuucaggggagacgugacaaauauccagggcagucauaccuauacgaugaaccucgcaagccugaauuggaacaauuacgauccgacugaggaaacacccgcuccucuugguaccccagacuuugucgggaagauccagggagugcugacucagacaaccaagggccaaggcucuacgcgggggcacaaggccaccguauacacaggauccgcuucauucacucccaaauuggguagcguucaguuucgcaccgacacacagaacgauuucgugacucaucaaaauaccaaguuuacaccugucggcgugauucaggacggggauaccacucaccgaaacgagccacagcaguggguccuccccaauuauaguggagugaacacgcacaauguucaucuggccccggcaguggccccuacaauaccaggcgaacaauuacuguucuuuagaucuuccaugcccgguuguagcggguacccuaacauggaccucgauugccuuguaccccaggaguggguccagcacuucuaucaggaagcugcgccagcacugucggacguggccuugcuaagguuuguuaacccugauaccggccgggugcuguucgaguguaaacuccauaagucuggauacgucacuguggcucacaccggccaccaugaccugguaauucccccaaauggguauuuucguuucgauuccugggugaaccaauuuuacacacuugccccgaugggaaaugguaccggccgcagaaggguuuga

SEQ ID NO: 20242 - RNA, 1620 nt, Artificial Sequence
  derived and/or modified sequence opt3 from VP1__Norovirus_and/or_Norovirus-like__KX354071
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucgggauuacaccaugaaucucgcuagccugaacuggaauaacuaugacccgacggaggaaauucccgccccucuugguacuccagacuucguagggaagauccagggaguucugacacagaccacuaagggcgauggcucuacacgcgggcacaaggcuaccguguacacgggauccgcccccuuuaccccuaaauuggguucaguccaguucagcacagacacugagaaugauuuugaaacccaucaaaacacaaaguucacuccagugggcgucauccagaaugggaguaccacacaccgaaacgagccccagcaaugggugcucccgucuuacuccggaagaaauguucagaacgugcaccuggccccugcaguagcuccaaccuuucccggcgaacaguuacuguucuuuaggagcacuaugccugguuguucgggguaucccaauauggaccucgauugccuucugccacaggaguggguccaacauuucuaccaggaggcggccccugcacagucugacguggcuuugcuacgguuuguuaaccccgauacgggccgugugcuguucgaauguaaacuccacaaguccggauaugucacaguggcccauaccggccagcacgaccugguaauuccaccgaacggguacuuucgcuucgauucaugggugaaucaauucuauacucuugcaccuaugggaaacgguaccggcagaaggcggguuuga

SEQ ID NO: 20243 - RNA, 1620 nt, Artificial Sequence
  derived and/or modified sequence opt3 from VP1__Norovirus_and/or_Norovirus-like__AB933688
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucgggacuacaccaugaaucucgcuagccugaacuggaauaacuaugauccgacggaagagauucccgccccucuugguacuccagacuucguagggaagauccagggaaugcugacacagaccacuaagggcgacggcucuacacgcgggcacaaggcuaccguuuacacgggauccgcccccuuuaccccuaaauuggguucagugcgauucagcacagauacugaaaaugacuuugagauccaucagaacaccaaguucacaccagucggcgugauucaagaugggaguacuacccacagaaaugaaccccagcaguggguccucccgucuuacuccggaagggacgcacacaacgugcaucuggccccugcuguugcgccaacauuucccggcgagcaauuacuguucuuucggagcaccaugccugguuguucgggguaucccaauauggaucucgacugccuucugccacaggagugggugcagcacuucuaccaggaagcagccccugcucaaucugauguagccuugcuacguuuugucaaccccgacacuggccgcgugcuguucgaguguaaacuccauaaguccggauauguuacgguggcacacacaggccagcacgaucuggucauaccaccgaauggguacuuuagauucgacucaugggugaaccaguucuauacccuugccccuaugggaaacgguacuggcaggcggcgaguauga

SEQ ID NO: 20244 - RNA, 1620 nt, Artificial Sequence
  derived and/or modified sequence opt3 from VP1__Norovirus_and/or_Norovirus-like__GQ845337
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugaggcacaucaaaauaccaaguucacaccagugggcgucauccaggacgggggaacuacccaccgaaacgaaccccagcaaugggugcucccgaguuacucuggcagaaauguuccuaacgugcaccuggccccagcuguagcgcccacauuuccuggugagcaguuacuguucuuuagguccaccaugcccggguguagcggcuauccaaauauggaucucgacugccuucugccucaggaguggguccagcauuucuaccaagaagcagcccccgcucagucggauguggccuugcuacgguuuguuaacccagacacuggacgugugcuguucgaguguaaacuccacaagucuggcuaugucacgguggcacauacagggcagcacgaucugguaauuccguccaacggauacuuucgcuucgacucaugggugaaucaguucuauacccuugccccuauggguaacggcacugggagaaggcggguuuga

SEQ ID NO: 20245 - RNA, 1620 nt, Artificial Sequence
  derived and/or modified sequence opt3 from VP1__Norovirus_and/or_Norovirus-like__JX155747
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguucagaacgugcaccuggccccugcaguagcuccaaccuuucccggugagcaguuacuguucuuuagguccacuaugccuggguguagcggcuaucccaauauggaucucgacugccuucugccacaggaguggguccaacauuucuaccaggaagcggccccugcacagucggauguggcuuugcuacgguuuguuaaccccgacacgggacgugugcuguucgaguguaaacuccacaagucuggcuaugucacaguggcccauaccgggcagcacgaucugguaauuccaccgaacggauacuuucgcuucgacuccugggugaaucaauucuauacucuugcaccuauggguaacggcaccgggagaaggcggguuuga

SEQ ID NO: 20246 - RNA, 1620 nt, Artificial Sequence
  derived and/or modified sequence opt3 from VP1__Norovirus_and/or_Norovirus-like__JX155737
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagucuggcuaugucacaguggcccauaccgggcagcacgaucugguaauuccgccuaacggauacuuucgcuucgacuccugggugaaucaguucuauacucuugcacccauggguaacggcaccgggagaaggcggguuuga

SEQ ID NO: 20247 - RNA, 1620 nt, Artificial Sequence
  derived and/or modified sequence opt3 from VP1__Norovirus_and/or_Norovirus-like__KX354055
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucgggccgacggcuccacacgcggccauaaggcuaccgucuacacggggucagccgauuuugcaccuaagcugggacgagugcaauucgagaccgacacaaaucacgauuuugaagccaaccagaauacuaaauucaccccaguuggugugauccaggacggcgggacaacucacagaaacgagccccaacaguggguauugccgagcuacaguggaaggaauacccauaacguccaccucgcuccugcgguggcaccaacauuucccggcgaacagcuguuauucuuucggucuaccaugccugguuguuccggguaucccaauauggaucuggacugccuccuuccacaggaguggguucaacauuucuaccaggaggccgcuccugcccagagcgauguggcacuguugcguuuugucaaccccgacacuggccgcgugcuauucgaauguaagcugcacaaaucgggauauguaacgguggcccacacaggccagcaugaucucguuauuccaccgaacggguacuuuagauucgacucuugggucaaucaauucuauacccuggcuccuaugggaaacgguacuggcaggcggcgaguguga

SEQ ID NO: 20248 - RNA, 1620 nt, Artificial Sequence
  derived and/or modified sequence opt3 from VP1__Norovirus_and/or_Norovirus-like__KX353957
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguuuacgggauccgcccccuucaccccuaaauuggguucaguccaguuuagcacagacacugaaaacgauuucgagacccaucaaaauacaaaguuuacuccagugggcgucauccaggacgggggaaccacacaccgaaacgaaccccagcaaugggugcucccgaguuacucuggcagaaauguucagaacgugcaccuggccccugcaguagcuccaaccuuccccggugagcaguuacuguuuuucagguccacuaugccuggguguagcggcuaccccaauauggaucucgacugccuucugccacaggaguggguccaacauuuuuaucaggaagcggccccugcacagucggauguggcuuugcuacgguucguuaaccccgacacgggacgugugcuguuugaguguaaacuccacaagucuggcuacgucacaguggcccauaccgggcagcacgaucugguaauuccaccgaacggauauuuccgcuucgacuccugggugaaucaauuuuacacucuugcaccuauggguaacggcaccgggagaaggcggguuuga

SEQ ID NO: 20249 - RNA, 1620 nt, Artificial Sequence
  derived and/or modified sequence opt3 from VP1__Norovirus_and/or_Norovirus-like__KF509947
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccaucuuaacugucgaggaaaugacaaauagccgcuuuccaauaccccuggagaaacuuuucaccggaccuuccucagccuucgugguucagccacagaacgguagauguacgacugauggcguguugcuggggaccacacaacuaaguccggucaauauuugcacuuuuaggggagacaucacccauauuacaggcagccggaacuacaccaugaaucucgcaucucagaacuggaauaacuaugaucccacggaggaaaucccugcuccacuggguacucccgacuucguggggaagauccagggaguacuuacacagaccacucgcgccgacggcuccacacgaggccacaaggcuauuguuuacaccgggucagccgauuuugcaccuaagcugggaagagugcaauucgagacggacaccgaucaugacuuugaagccaaucagaacacaaaauucacuccagucggugugacccaggauggcagcacaacucacaggaaugagccccaacagugggucuugccgaguuacucugggcggaacacccacaaugugcaucucgcuccugcgguugcaccaacauuucccggagaacagcuguuauucuuucguuccaccaugccuggcuguagcgguuaucccaacauggaccuggauugccuccuuccacaggagugggugcaauacuucuaucaggaggccgcuccugcccagucggacguagcacuguugcgcuuugucaaucccgauacugggagagugcuauucgaauguaagcugcacaaaucuggcuacguuacgguggcccauacaggacagcacgaccucgucauaccaccgaacggcuauuuuagguucgauuccugggugaaccaauucuacacccuggcuccuauggggaauggaacuggucggcgacgcguauga

SEQ ID NO: 20250 - RNA, 1620 nt, Artificial Sequence
  derived and/or modified sequence opt3 from VP1__Norovirus_and/or_Norovirus-like__AB504326
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacauuaugaaccucgcuagccugaauuggaacaauuaugacccgaccgaagagauccccgccccucuugguacgccagauuucguagggaagauccagggaguucugacucagacaaccaagggcgacggcucuacucgcgggcacaaggcuacaguguacaccggauccgcccccuuuacgccuaaauuggguucaguccaguucagcaccgacacagaaaacgauuuugagacucaucaaaauacccgauucacaccagugggcgucauucaggacgggggaacuacccacagaaacgaaccccagcaaugggugcucccgaguuacucuggcaggaauguuccuaacgugcaccuggcaccagccguagcucccacauuuccuggugagcaguuacuguucuuucgguccaccaugcccggguguagcggcuauccaaauauggaucucgacugccuucugccucaggaguggguccagcauuucuaccaagaagcggcacccgcccagucggauguggcuuugcuacguuuuguuaacccagacacuggacgcgugcuguucgaguguaagcuccacaaaucuggcuaugucacgguggcccauacagggcagcacgaucugguaauaccgccuaacggauacuuuagauucgacuccugggugaaucaguucuauacccuugcacccauggguaacggcacugggaggcggcgaguuuga

SEQ ID NO: 20251 - RNA, 1620 nt, Artificial Sequence
  derived and/or modified sequence opt3 from VP1__Norovirus_and/or_Norovirus-like__KX354056
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccaucuuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacuggaauaacuaugaucccacggaggaaauuccugcuccacuggguacucccgacuucguggggaagauccagggaguccuuacacagaccacucgcgccgacggcuccacacgaggccacaaggcuaccguguacacggggucagccgauuuugcaccuaagcugggaagaguccaauucgguaccgacacagaucaugacuuugaggccaaucagaacacuaaauucaccccagugggcguuauucaggaugggggaacaacucacaggaaugaaccccaacaguggguguugccgagcuacaguggccggaacacccacaauguacaucucgcuccugcggucgcaccaacauuucccggugagcagcuguuauucuuucguucuaccaugccuggguguuccggcuaucccaacauggaccuggauugccuccuuccacaggaaugggugcaauacuucuaucaggaggccgcuccugcccagagcgacguugcacuguugcgcuuugugaaucccgauacuggaagaguccuauucgaguguaagcugcacaaacucggcuacgugacgguagcccauacagggcagcacgaccuggugaucccaccgaacggauauuuuagguucgauucguggguuaaccaauucuacacccuugcuccuauggguaauggcacugggcggcgacgcgucuga

SEQ ID NO: 20252 - RNA, 1620 nt, Artificial Sequence
  derived and/or modified sequence opt3 from VP1__Norovirus_and/or_Norovirus-like__AB541255
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacacgauucacuccagugggcgucauccaggacgggggaaccacacacagaaacgaaccccagcaaugggugcucccgaguuacucuggcaggaauguuccuaacgugcaccuggcaccagccguagcucccaccuuuccuggugagcaguuacuguucuuucgguccacuaugcccggguguagcggcuauccaaauauggaucucgacugccuucugccucaggaguggguccagcauuucuaccaagaagcggcacccgcccagucggauguggcuuugcuacguuuuguuaacccagacacgggacgcgugcuguucgaguguaagcuccacaaaucuggcuaugucacaguggcccauaccgggcagcacgaucugguaauuccgccuaacggauacuuuagauucgacuccugggugaaucaguucuauacucuugcacccauggguaacggcaccgggaggcggcgaguuuga

SEQ ID NO: 20253 - RNA, 1620 nt, Artificial Sequence
  derived and/or modified sequence opt3 from VP1__Norovirus_and/or_Norovirus-like__KP784696
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucggggagauucagggagugcuuacacagaccacucgcacagacggcuccacccgaggccacaaggccacggucuacaccgggucagcugauuuugccccuaagcugggaagaauccaauucgaaacagacacugaucaugacuuugaggcaaaucagaacaccaaguucacaccaguggguguuauucaggauggcagcacuacccacaggaaugaaccccaacaguggguguugccgaguuacucugggcggaacacacacaauguacaucucgccccugcugucgcgccaaccuuucccggagagcagcuguuauucuuucguuccacuaugccuggcuguagcgguuaucccaacauggaccuggauugccuccuuccacaggagugggugcaauacuucuaucaggaagcagccccuucgcagucugacguugcucuguugcgcuuugugaaucccgauacggggagaguccuauucgaguguaaacugcacaaguccggcuacgugacaguagcccauaccggacagcacgaccucgugaucccaccgaacggcuauuuuagguucgauucauggguuaaccaauucuacacucuggcaccuauggggaauggaaccggucggcgacgcgucuga

SEQ ID NO: 20254 - RNA, 1620 nt, Artificial Sequence
  derived and/or modified sequence opt3 from VP1__Norovirus_and/or_Norovirus-like__KX354042
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccgucuuaacuguggaggaaaugacaaauagccgcuuuccaaucccccuggagaaacuuuucaccggaccuuccucagccuucguugugcagccacagaacgguagauguacgacugauggcgucuugcuggggaccacacaacuaaguagcgugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacacacaauguucaucucgccccggcuguggcgccuaccuuuccaggagaacagcuguuauucuuucguagcacuaugcccggcuguucggguuauccuaacauggaccuggauugccuccuuccccaggaguggguacaauacuucuaucaggaggcagccccagcucagucugacgucgcccuguugcgcuuugugaauccugauacggggagaguucuauucgaauguaagcugcacaaauccggcuacgugacagucgcacauaccggacagcacgaccucgugauucccccaaacggcuauuuuagguucgauucauggguaaaccaauucuacacucuggccccgauggggaauggaaccggucggcgacgcguguga

SEQ ID NO: 20255 - RNA, 1620 nt, Artificial Sequence
  derived and/or modified sequence opt3 from VP1__Norovirus_and/or_Norovirus-like__KX354007
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaagucccugcuccacuggguacucccgacuucguggggaagauacagggaaugcuuacacagaccacucgcacagacggcuccacccgaggccacaaggccacggucuacaccgggucagcugauuuuacaccuaagcugggaaggauucaauucgagacugacaccgaucaugacuuugaagccaaucagaacacaaaauucacuccaguggguguuauccaggauggcagcaccacacacagaaaugagccccaacaguggguguugccgaguuacucugggcggaacacccacaauguacaucucgccccugcagucgcuccaacuuuucccggagaacagcuguuauucuuucguuccacgaugccuggcuguagcgguuaucccaacauggaccuggauugccuccuuccacaggagugggugcaauacuucuaucaggaggcggccccugcacagucggacguugcucuguugcgcuuugugaaucccgauacagggagaguccuauucgaauguaagcugcacaaaucuggcuacgugaccguagcccauacuggacagcacgaccucgugauuccaccgaacggcuauuuuagguucgauuccuggguuaaccaauucuacacccuggcaccuauggggaauggaacaggucggcgacgcgucuga

SEQ ID NO: 20256 - RNA, 1620 nt, Artificial Sequence
  derived and/or modified sequence opt3 from VP1__Norovirus_and/or_Norovirus-like__KT780393
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagagacuuuucaccggaccuuccucagccuucgucgugcagccacagaacgguagguguacgacugauggcguauugcuggggaccacacaacuaacuccgguuaauauuugcaccuuucggggagacgugacacauaucaccggcagucgcaacuacacgaugaaucucgcaagccagaacuggaauaacuaugaucccacugaggaaauaccugcuccacuggguacacccgacuucgucgggaagauucagggaaugcuuacccagacuacacgaaccgacggcucuacgagaggccacaaagccaccguguacacaggguccgcugauuuugccccuaagcugggaaggguccaauucgagacugacaccgaucaugacuuugaagcaaaucagaacacaaaguucacuccaguggguguuauccaggauggcucaaccacacaccggaaugagccccaacaguggguguugccgagcuacagugggcguaacacccacaauguacaucucgccccugcugucgcgccaacuuuucccggagaacagcuguuauucuuucgcucuacgaugccuggcuguuccgguuaucccaacauggaccuggauugccuccuuccacaggagugggugcaacacuucuaccaggaggcagccccugcucagagcgacguugcccuguugagauuugugaaucccgauacagggaggguccuauucgaauguaaacugcauaagucgggcuaugugaccguagcacacacuggacagcacgaccucgugauuccaccgaacggcuacuuucgguucgauucuuggguuaaccaauucuauacccuggccccuauggggaauggaacaggucgacgcagagucuga

SEQ ID NO: 20257 - RNA, 1620 nt, Artificial Sequence
  derived and/or modified sequence opt3 from VP1__Norovirus_and/or_Norovirus-like__KX354043
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacauauaauguucaccucgccccggcuguggcgccuaccuuuccaggagaacagcuguuauucuuucguagcacuaugcccggcuguucggguuacccuaacauggaccuggauugccuccuuccccaggaguggguacaacauuucuaucaggaggcagccccagcucagucugacgucgcccuguugcgcuuugugaauccugauacggggagaguucuauucgaauguaagcugcacaaauccggcuacgugacagucgcacauaccggacagcacgaccucgugauucccccaaacggcuauuuuagguucgauucauggguaaaccaauucuacacucuggccccgauggggaauggaaccggucggcgacgcguguga

SEQ ID NO: 20258 - RNA, 1620 nt, Artificial Sequence
  derived and/or modified sequence opt3 from VP1__Norovirus_and/or_Norovirus-like__KX354008
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaagucccugcuccacuggguacucccgacuucguggggaagauacagggaaugcuuacacagaccacucgcacagacggcuccacccgaggccacaaggccacggucuacaccgggucagcugauuuuacaccuaagcugggaaggauucaauucgagacugacaccgaucaugacuuugaagccaaucagaacacaaaauucacuccaguggguguuauccaggauggcagcaccacacacagaaaugagccccaacaguggguguugccgaguuacucugggcggaacacccacaauguacaucucgccccugcagucgcuccaacuuuucccggagaacagcuguuauucuuucguuccacgaugccuggcuguagcgguuaucccaacauggaccuggauugccuccuuccacaggagugggugcaauacuucuaucaggaggcggccccugcacagucggacguugcucuguugcgcuuugugaaucccgauacagggagaguccuauucgaauguaagcugcacaaaucuggcuacgugaccguagccuauacuggacagcaugaccucgugauuccaccgaacggcuacuuuagguucgauuccuggguuaaccaauucuauacccuggcaccuauggggaauggaacaggucggcgacgcgucuga

SEQ ID NO: 20259 - RNA, 1620 nt, Artificial Sequence
  derived and/or modified sequence opt3 from VP1__Norovirus_and/or_Norovirus-like__KR904217
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucucugcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacgggaccuucaagugccuucgugguucagccacagaacgguagauguagcacugauggcguguugcuggggaccacacaacuaucuccggucaauauuugcacuuuuaggggagacgugacccauaucgcgggcucccacaacuacacaaugaaucucgccucacagaacuggagcaguuaugaucccaccgaggaaauuccugcaccacuggguacgcccgacuucguagggaagauccagggaguucuuacucagacaacccggucugacggcuccacucgcggccauaaggcuacaguguacaccgggagcgccgauuuuucgccuaagcugggacgaguccaauucgcuacggacaccgauaaugacuuugugucuaaccagaauacaaaauucacuccagucggugugauccaggauggcgacaccgcccacagaaacgagccccaacaguggguuuugccguccuacucagggaggaauauucacaacgugcaucucgccccugcaguagcuccaacauuucccggagaacagcuguuauucuuucggaguacuauaccuggcuguagcgguuaucccaauauggaucuggacugccuccuuccacaggaguggguccaauacuucuaucaggaagcggccccugcacaguccgauguggcucuguugcguuuuguuaaccccgacaccgggcgcgugcuauucgaguguaagcugcacaaaucuggcuacgucacaguggcccauaccggacagcacgaucucguaaucccaccgaauggcuauuuuagauucgacagcugggugaaccacuucuacacucuggcaccuauggggaacggaacggguaggcggcgaguuuga

SEQ ID NO: 20260 - RNA, 1620 nt, Artificial Sequence
  derived and/or modified sequence opt3 from VP1__Norovirus_and/or_Norovirus-like__KJ685412
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuugccccuaagcugggacgagugcaauucgcaacagacacugaucacgacuuugaggccaaucagaacaccaaauucacaccaguuggugugauccaggauggcgggacuacccacagaaaugaaccccaacaguggguauugccgagcuacaguggaaggaacacacauaauguccaccucgcuccugcgguggcaccaaccuuucccggcgagcagcuguuauucuuucggucuacuaugccugguuguuccggguaucccaacauggaccuggauugccuccuuccacaggaauggguucaauacuucuaucaggaggccgcuccugcccagagcgacguggcacuguugcguuuugucaaucccgauacgggccgcgugcuauucgaguguaagcugcauaaaucgggauacguaacaguggcccacaccggccagcacgaccucguuauuccaccgaacggguauuuuagauucgauucuugggucaaccaauucuacacucuggcuccuaugggaaaugguaccggcaggcggcgaguguga

SEQ ID NO: 20261 - RNA, 1620 nt, Artificial Sequence
  derived and/or modified sequence opt3 from VP1__Norovirus_and/or_Norovirus-like__KF008240
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaccccucuggagaaacuuuucacgggaccuuccucagccuucgucgugcagccacagaacgguagauguacuaccgauggcguauugcuggggacaacucaacuaaguccgguuaauaucugcaccuuuaggggagacgugacacauauuaccggcagccggaacuacacgaugaaucucgcaucucagaacuggaauaacuaugaucccacugaggaaaucccugcuccacuggguacacccgacuucgucgggaagauacagggagugcuuacccagacuacacgcaccgacggcuccacgcgaggccacaaggccaccgucuacacagggucagcugauuuugccccuaagcugggaagagugcaauucgagacugacaccgaucaugacuuugaaguuaaucagaacacaaaauucacuccaguggguguaauucaggauggcgggaccacacacaggaaugagccccaacagugggucuugccgagcuacaguggacggaacacccacaaugugcaucucgcacccgccguugcuccaacuuuucccggcgaacagcuguuauucuuucguucuacgaugccugguuguuccggguaucccaacauggaccuggauugccuccuuccacaggagugggugcaauacuucuaucaggaggcggccccugcacagagcgacgucgcucuguugcgcuuugugaaucccgauacaggcagaguacuauucgaauguaagcugcacaaaucgggauacgugaccguugcccauacuggccagcacgaccucgucaucccaccgaacggguauuuuagguucgauucuugggugaaccaauucuacacccuggcaccuaugggaaaugguacaggccggcgacgcguguga

SEQ ID NO: 20262 - RNA, 1620 nt, Artificial Sequence
  derived and/or modified sequence opt3 from VP1__Norovirus_and/or_Norovirus-like__KX354125
augaagauggccagcuccgacgcuaaccccucugauggcucagcagccaaucuggugccugaggcgaacaaugaagucauggcucucgagccaguugugggggccgcaaucgccgcuccgguagcaggacagcaaaacgugauugaccccuggauaagaaauaacuucguccaggccccugguggcgaauuuaccgugaguccaaggaaugcucccggggagauccuuuggagcgccccucugggaccagauuugaaccccuacuuaucccaccuggcgcggauguauaauggcuacgccgguggguucgaaguucaggugauucuagcaggaaacgcuuuuacagccggcaaagucaucuucgcagcugugccuccaaauuuuccgacugagggccucucucccucgcagguaacgauguucccucauauuguuguggacguccgccaacuggagccagugcuuaucccccugccugaugugcgaaacaauuuuuaucacuacaaccagucaaaugacccaaccauaaaguugaucgccaugcucuauacaccccugcgugcgaacaacgccggggaugacgucuucacuguuagcugcagagugcugaccaggccgaguccugauuuugacuucauuuuucucguacccccaacaguggaaucccggaccaaaccuuucucuguccccguguuaacuguugaggaaaugacaaauagccgcuuuccaaucccccuggagaaacuuuucaccggaccuuccucagcauucgugguccagccacagaacgguagauguacgacugauggcguguugcuggggaccacacaacuaaguccgguaaauauuugcacuuuuaggggagacguuacccauaucacaggcagccggaacuacaccaugaaucucgcuucucagaacuggaauaacuaugaucccacggaggaaauaccugccccacuggguacucccgacuucguggggaagauucagggaaugcuuacacagaccacucgcgcugacggcuccacacgaggccacaaggccaccgucuacacggggucagcagauuuuagcccuaagcugggaagagugcaauucgagaccgacacagaucaugacuuugaagccaaucagaacacuaaauucaccccagucggugugauccaggauggcaguacaacucacaggaaugagccccaacaguggguuuugccgucuuacuccgggcggaacacccacaaugugcaucucgcuccugcgguagcaccaacauuucccggagaacagcuguuauucuuucguagcaccaugccuggcuguucggguuaucccaacauggaccuggauugccuccuuccacaggaguggguccaauacuucuaucaggaggccgcuccugcccagucugacguggcacuguugcgcuuuguuaaucccgauacugggagagugcuauucgaauguaagcugcacaaauccggcuacgucacgguggcccauacaggacagcacgaccucguaauuccaccgaacggcuauuuuagguucgauucaugggugaaccaauucuacacccuggcuccuauggggaauggaacuggucggaagcgaguuuga

SEQ ID NO: 20263 - RNA, 1620 nt, Artificial Sequence
  derived and/or modified sequence opt3 from VP1__Norovirus_and/or_Norovirus-like__KX354094
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcagcacuacccacaggaaugagccccaacaguggguauugccgaguuacucugggcggaacacacacaauguccaucucgccccugcuguggcgccaaccuuucccggagaacagcuguuauucuuucguuccacuaugccuggcuguagcgguuaucccaacauggaccuggauugccuccuuccacaggaguggguucaauacuucuaucaggaggcagccccugcucagucggacguggcccuguugcgcuuugucaaucccgauacggggagagugcuauucgaauguaagcugcacaaaucuggcuacguaacaguggcacauaccggacagcacgaccucguuauuccaccgaacggcuauuuuagguucgauuccugggucaaccaauucuacacucuggccccuauggggaauggaaccggucggcgacgcguguga

SEQ ID NO: 20264 - RNA, 1620 nt, Artificial Sequence
  derived and/or modified sequence opt3 from VP1__Norovirus_and/or_Norovirus-like__KX354058
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucgcaggcagccggaacuacacaaugaaucucgcuucucagaacuggaauaacuaugaucccaccgaggaaauaccugccccacuggguacgcccgacuucgucgggaagauucagggaaugcuuacucagacaacccgcacugacggcuccacacgaggccacaaggcuaccguguacacggggucagccgaguuugcaccuaagcugggaagaguccaauucgaaaccgauacagaccaugauuuugagacuaaucagaacaccaaauucacaccaguggguguuauccaggacggcagcacuacccacaggaaugaaccccaacaguggguguugccgaguuacucugggcggaacacacacaauguacaucucgccccugcugucgcgccaaccuuucccggagagcagcuguuauucuuucguuccacuaugccuggcuguagcgguuaucccaacauggaucuggacugccuccuuccacaggagugggugcaauacuucuaucaggaagcagccccugcucagucggauguugcccuguugcgcuuugugaaucccgacacggggagaguccuauucgaguguaagcugcacaaaucuggcuacgugacaguagcacauaccggacagcacgaucucgugauuccaccgaacggcuauuuuagguucgacuccuggguuaaccaauucuacacucuggccccuauggggaauggaaccggucggcgacgcgucuga

SEQ ID NO: 20265 - RNA, 1620 nt, Artificial Sequence
  derived and/or modified sequence opt3 from VP1__Norovirus_and/or_Norovirus-like__KX354057
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggaaugcuuacacagaccacucgcacagacggcuccacccgaggccacaaggccacgguguacaccgggucagcugaguuugccccuaagcugggaagaguccaauucgaaacagauacugaccaugauuuugagaccaaucagaacacaaaauucacuccaguggguguuauccaggacggcagcaccacacacaggaaugaaccccaacaguggguguugccgaguuacucugggcggaacacccacaauguacaucucgccccugcagucgcuccaacuuuucccggagagcagcuguuauucuuucguuccacgaugccuggcuguagcgguuaucccaacauggaucuggacugccuccuuccacaggagugggugcaauacuucuaucaggaagcggccccugcacagucggauguugcucuguugcgcuuugugaaucccgacacagggagaguccuauucgaguguaagcugcacaaaucuggcuacgugaccguagcccauacuggacagcacgaucucgugauuccaccgaacggcuauuuuagguucgacuccuggguuaaccaauucuacacccuggcaccuauggggaauggaacaggucggcgacgcgucuga

SEQ ID NO: 20266 - RNA, 1620 nt, Artificial Sequence
  derived and/or modified sequence opt3 from VP1__Norovirus_and/or_Norovirus-like__KX354034
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggaacaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacacacaacguccaucucgccccugcuguggcgccaaccuuucccggcgaacagcuguuauucuuucguuccacuaugccugguuguagcggguaucccaauauggaccuggauugccuccuuccacaggaguggguucaauacuucuaucaggaggcagccccugcucagucggacguggcccuguugcgcuuugucaaccccgauacgggcagagugcuauucgaauguaagcugcacaaaucuggauacguaacaguggcacauaccggccagcacgaccucguuauuccaccgaauggguauuuuagguucgauuccugggucaaccaauucuacacucuggccccuaugggaaacgguaccggccggcgacgcguguga

SEQ ID NO: 20267 - RNA, 1620 nt, Artificial Sequence
  derived and/or modified sequence opt3 from VP1__Norovirus_and/or_Norovirus-like__KX354027
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauacaaccggcagccggaacuacacgaugaaucucgcaucucagaacuggaauaacuaugaucccacugaggaaaucccugcuccacugggugcccccgacuucgucgggaagauacagggaaugcuuacacagaccacucgcgcugacggcuccacacgaggccacaaggccaccguguacacggggucagcagauuuugccccuaagcugggaagaguccaauucgagaccgacacagaucaugacuuugaagcuaaucagaacacuaaauucaccccaguggguguuauucaggauggcagcacaacucacaggaaugagccccaacaguggguguugccgaguuacucugggcggaacacccacaauguacaucucgcgccugcagucgccccaacauuucccggagaacagcuguuauucuuucguuccaccaugccuggcuguagcgguuaucccaacauggaccuggauugccuccuuccacaggagugggugcaauacuucuaucaggaggcugccccugcacagucggacguugcccuguugcgcuuugugaaucccgauacugggagaguccuauucgaauguaagcugcacaaaucuggcuacgugacgguagcucauacaggacagcacgaccucgugaucccaccgaacggcuauuuuagguucgauuccuggguuaaccaauucuacacccuggccccuauggggaauggagcaggucggcgacgcgucuga

SEQ ID NO: 20268 - RNA, 1620 nt, Artificial Sequence
  derived and/or modified sequence opt3 from VP1__Norovirus_and/or_Norovirus-like__KX354025
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcgccgacggcuccacacgaggccacaaggcuaccgucuacacggggucagccgauuuugcaccuaagcugggaagagugcaauucgagaccgacacagaucaugacuuugaagccaaucagaacacuaaauucaccccaguuggugugauccaggauggcgggacaacucacaggaaugagccccaacaguggguauugccgagcuacaguggacggaacacccacaauguccaucucgcuccugcgguggcaccaacauuucccggcgaacagcuguuauucuuucguucuaccaugccugguuguuccggguaucccaacauggaccuggauugccuccuuccacaggaguggguucaauacuucuaucaggaggccgcuccugcccagagcgacguggcacuguugcgcuuugucaaucccgauacuggcagagugcuauucgaauguaagcugcacaaaucgggauacguaacgguggcccauacaggccagcacgaccucguuauuccaccgaacggguauuuuagguucgauucuugggucaaccaauucuacacccuggcuccuaugggaaaugguacuggccggcgacgcguguga

SEQ ID NO: 20269 - RNA, 1620 nt, Artificial Sequence
  derived and/or modified sequence opt3 from VP1__Norovirus_and/or_Norovirus-like__KJ685406
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggaggcagccccugcucagagcgacguggcccuguugcgcuuugucaaucccgauacgggcagagugcuauucgaauguaagcugcacaaaucgggauacguaacaguggcacauaccggccagcacgaccucguuauuccaccgaacggguauuuuagguucgauucuugggucaaccaauucuacacucuggccccuaugggaaaugguaccggccggcgacgcguguga

SEQ ID NO: 20270 - RNA, 1620 nt, Artificial Sequence
  derived and/or modified sequence opt3 from VP1__Norovirus_and/or_Norovirus-like__KF008241
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuagcauuugcacuuuuaggggagacgugacccauaucacaggcucucggaauuacaccaugaaccucgcaucccagaauuggaacaauuaugaucccacggaggaaauaccugcuccacuggguacucccgacuucgucgggaagauucagggaaugcuuacacagaccacucgcgccgacggcucaacacgaggccacaaggcuaccguguacacggggagcgccgauuuugcaccuaagcugggaagaguccaauucgagaccgacacagaucaugacuuugaagccaaccagaauacuaaauucaccccaguggguguuauccaggauggcaguacaacucacaggaacgagccccaacaguggguguugccgucuuacuccgggcggaauacccacaacguacaucucgcuccugcggucgcaccaacauuucccggagaacagcuguuauucuuucguagcaccaugccuggcuguucggguuaucccaauauggaccuggauugccuccuuccacaggagugggugcaauacuucuaucaggaggccgcuccugcccagucugacguugcacuguugcgcuuugugaaccccgauacugggagaguccuauucgaauguaagcugcacaaauccggcuacgugacgguagcccauacaggacagcacgaccucgugauuccaccgaauggcuauuuuagguucgauucauggguuaaccaauucuacacccuggcuccuauggggaacggaacuggucggcgacgcgucuga

SEQ ID NO: 20271 - RNA, 1620 nt, Artificial Sequence
  derived and/or modified sequence opt3 from VP1__Norovirus_and/or_Norovirus-like__AB504327
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggagugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacacgauucacuccagugggcgucauccaggacgggggaaccacacacagaaaugaaccccagcaaugggugcucccgucuuacuccggcaggaacguuccuaaugugcaccuggcaccagccguagcucccaccuuuccuggugagcaguuacuguucuuucggagcacuaugcccggguguucgggcuauccaaacauggaucucgacugccuucugccucaggaguggguccagcauuucuaccaagaagcggcacccgcccagucugauguggcuuugcuacguuuuguuaauccagacacgggacgcgugcuguucgaguguaagcuccacaaauccggcuaugucacaguggcccauaccgggcagcacgaucugguaauuccgccuaacggauacuuuagauucgacucaugggugaaccaguucuauacucuugcacccauggguaauggcaccgggaggcggcgaguuuga

SEQ ID NO: 20272 - RNA, 1620 nt, Artificial Sequence
  derived and/or modified sequence opt3 from VP1__Norovirus_and/or_Norovirus-like__KY424329
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccgucuuaacuguggaggaaaugacaaauagccgcuuuccaaucccccuggagaaacuuuucaccggaccuuccucagccuucguugugcagccacagaacgguagauguacgacugauggcgucuugcuggggaccacacaacuaaguccggugaauauaugcaacuuuaggggagacguaacucauauuaccggcagccggaauuacacaaugaaccucgcaucucagaauuggaacaauuaugaucccaccgaggaaaucccugcuccacuggguacgcccgacuucguugggaagauucagggaaugcuuacucagacaacccgcacugacggcuccacacgaggccacaaggccaccguguacacggggucagcugauuuugccccuaagcugggaagaguccaauucgagaccgacacagaucaugacuuugaagcaaaccagaauacuaaauucaccccagugggugucauccaggauggcagcacaacucacaggaacgagccccaacaguggguguugccgaguuacucugggcggaauacccacaacguucaucucgccccugcuguggcgccaacauuucccggagaacagcuguuauucuuucguuccaccaugccuggcuguagcgguuaucccaauauggaccuggauugccuccuuccacaggaguggguacaauacuucuaucaggaggcagccccugcucagucggacgucgcccuguugcgcuuugugaaccccgauacugggagaguucuauucgaauguaagcugcacaaaucuggcuacgugacggucgcacauacaggacagcacgaccucgugaucccaccgaacggcuauuuuagguucgauuccuggguaaaucaauucuacacccuggccccuauggggaacggaacuggucggcgacgcguguga

SEQ ID NO: 20273 - RNA, 1620 nt, Artificial Sequence
  derived and/or modified sequence opt3 from VP1__Norovirus_and/or_Norovirus-like__KT780389
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacugggugcccccgacuucgucgggaagauucagggagugcuuacucagacaacccgcgcugacggcuccacucgaggccacaaggccacagucuacaccgggucagcagauuuugccccuaagcugggaagagugcaauucgagacggacaccgaucaugacuuugaagcuaaucagaacacaaaauucacuccaguuggugugauccaggauggcagcaccacacacaggaaugagccccaacaguggguauugccgaguuacucugggcggaacacucacaauguccaucucgcgccugcaguggccccaaccuuucccggagaacagcuguuauucuuucguuccacaaugccuggcuguagcgguuaucccaacauggaccuggauugccuccuuccacaggaguggguucaauacuucuaucaggaggcugccccugcacagucggacguggcccuguugcgcuuugucaaucccgauaccgggagagugcuauucgaauguaagcugcacaaaucuggcuacguaacuguggcucauacgggacagcacgaccucguuauuccaccgaacggcuauuuuagguucgauuccugggucaaccaauucuacacacuggccccuauggggaauggagcaggucggaagcgaguguga

SEQ ID NO: 20274 - RNA, 1620 nt, Artificial Sequence
  derived and/or modified sequence opt3 from VP1__Norovirus_and/or_Norovirus-like__KX354134
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccuaucuuaacugucgaggaaaugacaaauucccgcuuucccauaccacuggagaaacuuuucaccggacccucaagugccuucgugguucagccucagaacgguagauguacgacugauggcguguugcuggggaccacacaacuaagcccagucaauauuugcacuuuuaggggagacaucacccauauuacaggcucucacaacuacaccaugaaucucgcaucccagaacuggaacucauaugauccgacggaggaaauccccgcuccucuggguacuccagacuucguggggaagauccagggaguacuuacacagaccacucgggccgacggcagcacacgcggccauaaggcuaccguuuacacggggagugccgauuuugcacccaagcugggacgagugcaauucgagaccgacacaaaucacgauuuugaagccaaucagaacacuaaauucaccccugucggugugauucaggacggcucuacaacucacagaaaugagccacaacagugggucuugcccuccuacagcgggaggaacacccauaaugugcaccucgcuccggcgguugcaccuacauuuccaggagaacagcuguuauucuuucggucgaccaugcccggcuguucugguuauccuaacauggaucuggacugccuccuuccccaggagugggugcaauucuuuuaccaggaggccgcuccagcccaguccgauguagcacuguugcguuucgucaauccugacacugggcgcgugcuauuugaauguaagcugcauaaaucaggcuauguuacgguggcccacacaggacagcacgaucucgucauacccccaaacggcuacuucagauucgacaguugggugaaccaauuuuauacccuggcuccgauggggaauggaacugguaggcggcgaguauga

SEQ ID NO: 20275 - RNA, 1620 nt, Artificial Sequence
  derived and/or modified sequence opt3 from VP1__Norovirus_and/or_Norovirus-like__KX354126
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggaaugcuuacacagaccacucgcgccgacggcuccacacgaggccacaaggcuaccguguacacggggucagccgauuuuagcccuaagcugggaagaguccaauucgagaccgacacagaucaugacuuugaagcaaaucagaacacuaaauucaccccaguggguguuauccaggauggcaguacaacucacaggaaugagccccaacaguggguguugccgucuuacuccgggcggaacacccacaauguacaucucgccccugcugucgcgccaacauuucccggagaacagcuguuauucuuucguagcaccaugccuggcuguucggguuaucccaacauggaccuggauugccuccuuccacaggagugggugcaauacuucuaucaggaggcagccccugcucagucugacguugcccuguugcgcuuugugaaucccgauacugggagaguccuauucgaauguaagcugcacaaauccggcuacgugacgguagcacauacaggacagcacgaccucgugauuccaccgaacggcuauuuuagguucgauucauggguuaaccaauucuacacccuggccccuauggggaauggaacuggucggaagcgagucuga

SEQ ID NO: 20276 - RNA, 1620 nt, Artificial Sequence
  derived and/or modified sequence opt3 from VP1__Norovirus_and/or_Norovirus-like__KR904237
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagagauaauuucgugcaggcaccugguggcgaauuuaccguuaguccaaggaacgcccccggggagauccuuuggagcgcuccucugggaccagacuugaaucccuacuuaucccaccuggcccggauguauaacggcuacgcggguggguucgaagugcaggucauucuagcaggaaaugccuuuacagcuggcaaagugaucuucgccgcaguaccuccaaacuuuccgacugagggccucucucccucgcagguuacgauguucccucauaugauuguggauguccgccaacuggagccagugcuuaucccccugccugacgugcgaaauaacuuuuaucacuacaaucagucaaacgauccaaccuugaagcucauagcuaugcuguauacaccccugcgugccaauaacgcgggggacgaugucuucacuguuagcugcagagugcucaccaggccgaguccugacuuugauuucaucuuuuuaguacccccaacaguggaaucccggaccaaaccuuucucuguccccgugcugacuguugaggaaaugacaaacagccgcuuuccaauuccccuugagaaguuguucaccggaccuuccucagccuucgugguccagccacagaaugguagauguacgacugacggcgugcugcuagggaccacacaacucaguccgguaaacaucugcacuuuuaggggagauguuacccauauuacaggcagccggaauuacaccaugaaccuggcaucucagaauuggaacaauuaugaccccacggaggaaaucccugcuccacuuggugcccccgacuucguggggaaaauacagggaaugcugacucagacaacccgcacugauggcuccacacgaggccacaaggcuaccgucuacacggggucagccgacuuugcaccuaaguugggaagagugcaauucgagaccgauacagaccaugauuuugaagccaaccagaauacuaaauucaccccagucggugugauucaggacggcagcacaacucacaggaacgagccccaacaguggguucucccgaguuacucugggcggaauacccacaacgugcaucuggcuccugcgguagcaccaacauuucccggagaacaguuacuguucuuucguuccaccaugccuggcuguagcgguuaucccaauauggaucucgacugccuucugccacaggaguggguccaauacuucuaucaggaggccgcuccugcccagucggauguggcauugcuacgcuuuguuaaccccgacacugggagagugcuguucgaauguaagcuccacaaaucuggcuacgucacgguggcccauacaggacagcacgaucugguaaucccaccgaauggcuauuuuagguucgacuccugggugaaccaauucuacacccuugcuccuauggggaacggaacuggucggcgacgcauuuga

SEQ ID NO: 20277 - RNA, 1620 nt, Artificial Sequence
  derived and/or modified sequence opt3 from VP1__Norovirus_and/or_Norovirus-like__KP241911
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggaaugcuuacacagaccacucgcacagacggcuccacccgaggccacaaggccacgguguacaccgggucagcugauuuugccccuaagcugggaagaguccaauucgagacagacacugaucaugacuuugaagcaaaucagaacaccaaauucacaccaguggguguuauccaggauggcagcacuacccacaggaaugagccccaacaguggguguugccgaguuacucugggcggaacacacacaauguacaucucgccccugcugucgcgccaaccuuucccggagaacagcuguuauucuuucguuccacuaugccuggcuguagcgguuaucccaacauggaccuggauugccuccuuccacaggagugggugcaauacuucuaucaggaggcagccccugcucagucggacguugcccuguugcgcuuugugaaucccgauacggggagaguccuauucgaauguaagcugcacaaaucuggcuacgugacaguagcacauaccggacagcacgaccucgugauuccaccgaacggcuauuuuagguucgauuccuggguuaaccaauucuacacucuggccccuauggggaauggaaccggucggcgacgcgucuga

SEQ ID NO: 20278 - RNA, 1620 nt, Artificial Sequence
  derived and/or modified sequence opt3 from VP1__Norovirus_and/or_Norovirus-like__KJ685411
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucugaacuggaauaacuaugaucccacggaggaaauaccugcuccacuugguacucccgacuucgucgggaagauucagggaaugcugacacagaccacucgcacagacggcuccacccgaggccacaaggccacgguguacaccgggucagcugauuuugccccuaaguugggaagaguccaguucgagacagacacugaucaugacuuugaagcaaaucaaaacaccaaauucacaccaguggguguuauccaggauggcagcacuacccacaggaaugagccccagcaaugggugcucccgaguuacucugggcggaacacacacaauguacaucuggccccugcugucgcgccaaccuuucccggagaacaguuacuguucuuucguuccacuaugccuggcuguagcgguuaucccaacauggaccucgauugccuucugccacaggagugggugcaguacuucuaucaagaggcagccccugcucagucggacguugccuugcuacgcuuugugaaucccgauacggggagaguccuguucgaauguaagcuccacaaaucuggcuacgugacaguagcacauaccggacagcacgaccuggugauuccaccgaacggcuauuuuagguucgauuccuggguuaaccaguucuacacucuugccccuauggggaauggaaccggucggcgacgcgucuga

SEQ ID NO: 20279 - RNA, 1620 nt, Artificial Sequence
  derived and/or modified sequence opt3 from VP1__Norovirus_and/or_Norovirus-like__KF008242
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcagcacuacccacaggaaugagccccaacaguggguauugccgaguuacucugggcggaacacacacaauguccaucucgccccugcuguggcgccaaccuuucccggagaacagcuguuauucuuucguuccacuaugccuggcuguagcgguuaucccaacauggaccuggauugccuccuuccacaggaguggguucaauacuucuaucaggaggcagccccugcucagucggacguggcccuguugcgcuuugucaaucccgauacggggagagugcuauucgaauguaagcugcacaaaucuggcuacguaacaguggcacauaccggacagcacgaccucguuauuccaccgaacggcuauuuuagguucgauuccugggucaaccaauucuacacucuggccccuauggggaauggaaccggucggaagcgaguguga

SEQ ID NO: 20280 - RNA, 1620 nt, Artificial Sequence
  derived and/or modified sequence opt3 from VP1__Norovirus_and/or_Norovirus-like__KF060112
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacugggugcccccgacuucgucgggaagauucagggaaugcuuacucagacaacccgcacugacggcuccacacgaggccacaaggcuaccguguacacggggucagccgauuuugcaccuaagcugggaagaguccaauucgagaccgacacagaucaugacuuugaagccaaucagaacacuaaauucaccccaguggguguuauccaggauggcagcacaacucacaggaaugagccccaacaguggguguugccgaguuacucugggcggaacacccacaauguacaucucgcuccugcggucgcaccaacauuucccggagaacagcuguuauucuuucguuccaccaugccuggcuguagcgguuaucccaacauggaccuggauugccuccuuccacaggagugggugcaauacuucuaucaggaggccgcuccugcccagucggacguugcacuguugcgcuuugugaaucccgauacugggagaguccuauucgaauguaagcugcacaaaucuggcuacgugacgguagcccauacaggacagcacgaccucgugauuccaccgaacggcuauuuuagguucgauuccuggguuaaccaauucuacacccuggcuccuauggggaauggaacuggucggcgacgcgucuga

SEQ ID NO: 20281 - RNA, 1620 nt, Artificial Sequence
  derived and/or modified sequence opt3 from VP1__Norovirus_and/or_Norovirus-like__JX126912
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacuccuacgccggcgguuucgaagugcaggucauucuagcggggaaugcauuuacugccggaaaaaucauuuucgcugccgugccuccaaacuuuccgacggagggccucucucccucgcagguaaccauguucccucauaucauaguugacgugcgccaacuggagccaguccuuaucccccugccugaugugcgaaauaacuuuuaucacuacaaucagucaaacgacccaacaauuaaguugaucgcaaugcucuauacuccccugcgugcuaacaaugccggcgaagauguguucaccgucagcugcagaguucugacaaggccgaguccugacuuugauuucauuuuucucgugcccccaaccguagagucccggacuaaaccuuucacagugcccaucuuaaccgucgaagagaugacgaacucucgcuuuccaauaccccuggagaaacuuuucacugggccuagcggagcguucgugguucagccacagaaugguagauguaccacagacggcguguugcuggggacuacccaacuauccccggucaacauuugcacauuuaggggagaugugacccauaucgccggcacgcacaauuacacuaugaaccucgcaucacagaauuggaacaauuaugaccccacagaagagauuccugcuccacuggguacccccgauuucguagggcggauccagggaaugcuuacucagacaacccgcggcgacggcaguacgcgagggcauaaggccaccguuagcacaggagacgugcacuuuacuccuaagcuggguucuauccaauucaacaccgauacaaauaacgacuuugaaacuggccagaauaccaaguucacaccagucggggugauucaggauggaaacggcacccaccaaaaugagccccagcagugggucuugccguccuacucagguagaacugggcauaacgugcaccucgcuccugccguugcaccaacguuucccggcgaacagcuguuauucuuuaggagcacaaugccuggauguaguggcuaccccaacaugaaucuggacugccuccuuccacaagagugggugcagcauuucuaucaggaggccgcuccugcgcagucugauguagcacuguugcgguuugucaaccccgacaccgggcgugugcuauucgaauguaaacugcacaaguccggauacguuacuguggcccacaccggucaacaugaucucgucauaccaccgaauggcuauuuucgcuucgacagcugggugaaccaguucuacacacuggcuccuauggggaauggaaccggcagaaggcggguauga

SEQ ID NO: 20282 - RNA, 1620 nt, Artificial Sequence
  derived and/or modified sequence opt3 from VP1__Norovirus_and/or_Norovirus-like__KX354143
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccaucguguacacggggagcgcugauuuugcccccaagcugggaagaguccaauucgagaccgacacagaucaugacuuugaagcaaaucagaacacuaaauucaccccugugggugucauccaggauggcaguacaacucacaggaaugagccacaacaguggguguugcccucuuacuccgggcggaacacccacaauguucaucucgccccggcuguggcgccuacauuuccaggagaacagcuguuauucuuucguagcaccaugcccggcuguucggguuauccuaacauggaccuggauugccuccuuccccaggaguggguacaauacuucuaucaggaggcagccccagcucagucugacgucgcccuguugcgcuuugugaauccugauacugggagaguucuauucgaauguaagcugcacaaauccggcuacgugacggucgcacauacaggacagcacgaccucgugauucccccaaacggcuauuuuagguucgauucauggguaaaccaauucuacacccuggccccgauggggaauggaacuggucggcgacgcguguga

SEQ ID NO: 20283 - RNA, 1620 nt, Artificial Sequence
  derived and/or modified sequence opt3 from VP1__Norovirus_and/or_Norovirus-like__KU985164
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacugggugcccccgacuucgucgggaagauucagggaaugcuuacucagacaacccgcgcugacggcuccacucgaggccacaaggccacaguguacaccgggucagcagauuuugccccuaagcugggaagaguccaauucgagacggacaccgaucaugacuuugaagcuaaucagaacacaaaauucacuccaguggguguuauccaggauggcagcaccacacacaggaaugagccccaacaguggguguugccgaguuacucugggcggaacacucacaauguacaucucgcgccugcagucgccccaaccuuucccggagaacagcuguuauucuuucguuccacaaugccuggcuguagcgguuaucccaacauggaccuggauugccuccuuccacaggagugggugcaauacuucuaucaggaggcugccccugcacagucggacguugcccuguugcgcuuugugaaucccgauaccgggagaguccuauucgaauguaagcugcacaaaucuggcuacgugacuguagcucauacgggacagcacgaccucgugauuccaccgaacggcuauuuuagguucgauuccuggguuaaccaauucuacacacuggccccuauggggaauggagcaggucggcgacgcgucuga

SEQ ID NO: 20284 - RNA, 1620 nt, Artificial Sequence
  derived and/or modified sequence opt3 from VP1__Norovirus_and/or_Norovirus-like__KX950760
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcagguccuacucgcaggaaacgccuuuacagcuggcaaagugauuuucgccgcaguaccuccaaauuuuccgacugagggccugucucccucgcagguuacgauguucccucauaucguggucgacgugcgccaacuugagccagugcugauucccuugccugauguccgaaacaauuuuuaucacuacaaccagucaaaugacagcaccaucaagcucauagcuaugcuguauacaccacugcgugccaacaacgcgggggaugacguuuucacugugaguugcagaguacucaccaggcccuccccggauuuugacuucaucuuuuuagugccucccacagucgaaucucggaccaaaccauucagcauuccugugcugacuguugaggaaaugacaaauucccgcuuucccaucccacuugagagauuguucaccggacccucaagugccuucgugguccagccucagaacgguagguguacgacugauggcgugcugcuagggaccacacaacucagcccaguaaauauuugcacuuuucggggagacguuacccauaucacaggcucucgcaacuacaccaugaaucuggcaucccagaacuggaauaacuaugauccgacggaggaaauacccgcuccucuugguacuccagacuucguggggaagauucagggaaugcugacacagaccacucgagccaauggcucaacaagaggccacaaagcuaccgucuacacggggagcgccgacuuugcacccaaguugggaagggugcaauucgagaccgauacaagugacgauuuugaaacuucucagaacaccaaguucacaccugucggugugauccaggacggcuccacuaccccacggaaugagccccaacaguggguucucccgagcuacucggggcguaacacacauaaugugcaccuggccccugcuguagcgccaaccuuucccggagaacaguuacuguucuuucgcucuauuaugccuggcuguuccgguuaucccaacauggaucucgacugccuucugccacaggaguggguccaacacuucuaccaggaggcagccccugcucagucagauguggccuugcuaagauuuguuaaucccgacacugggagggugcuguucgaauguaaacuccauaagaguggcuaugucacgguggcacacacaggacagcaugaucugguaaucccaccgaacggcuacuuucgguucgacagcugggugaaccaauucuauacccuugccccuauggggaauggaacuggucgacgcagaguuuga

SEQ ID NO: 20285 - RNA, 1620 nt, Artificial Sequence
  derived and/or modified sequence opt3 from VP1__Norovirus_and/or_Norovirus-like__KJ685402
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccggugccuucgucgugcagccacagaacggcagauguacgacugaugggguauugcugggaaccacacaacuaucaccgguuaauauuugcacuuuuaggggcgacgugacccauaucacagguagucggaacuacaccaugaaucucgcaagccagaacuggaauaacuaugaucccacggaggaaauaccugcuccacuggggacucccgacuucgucggaaagauucagggcaugcuuacacagaccacucgcacagacggcucuacccgagggcacaaggccacgguguacaccggauccgcugauuuugccccuaagcuggguagaguccaauucgagacagacacugaucaugacuuugaagcaaaucagaacaccaaauucacaccagugggcguuauccaggaugggucaacuacccacaggaaugagccccaacaguggguguugccgagcuacaguggacggaacacacacaauguacaucucgccccugcugucgcgccaaccuuucccggcgaacagcuguuauucuuucguucuacuaugccugguuguuccggguaucccaacauggaccuggauugccuccuuccacaggagugggugcaauacuucuaucaggaggcagccccugcucagagcgacguugcccuguugcgcuuugugaaucccgauacgggcagaguccuauucgaauguaagcugcacaaaucgggauacgugacaguagcacauaccggccagcacgaccucgugauuccaccgaacggguauuuuagguucgauucuuggguuaaccaauucuacacucuggccccuaugggaaaugguaccggccggcgacgcgucuga

SEQ ID NO: 20286 - RNA, 1620 nt, Artificial Sequence
  derived and/or modified sequence opt3 from VP1__Norovirus_and/or_Norovirus-like__KF060140
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugauauucgaaacaauuuuuaucacuacaaccagucaaaugacagcaccaucaaguugauugcuaugcucuauacaccacugcgugccaacaacgcgggggaugacguguucacugugaguugcagaguccugaccaggcccuccccggauuuugacuucaucuuucucguuccucccacaguggaaucucggaccaaaccauucagcguaccuguguuaacugucgaggaaaugacaaauucccgcuuucccauaccacuggagaaacuuuucaccggacccucaagugccuucgugguucagccucagaacgguagauguacgacugauggcguguugcuggggaccacacaacuaagcccagucaauauuugcacuuuuaggggagacgugacccauaucacaggcucucggaacuacaccaugaaucucgcaucccagaacuggaauaacuaugauccgacggaggaaauucccgcuccucuggguacuccagacuucguagggaagauccagggaguucuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacacacaauguucaucucgccccggcuguggcgccuaccuuuccaggagaacagcuguuauucuuucguagcacuaugcccggcuguucggguuauccuaacauggaccuggauugccuccuuccccaggaguggguacaauacuucuaucaggaggcagccccagcucagucugacgucgcccuguugcgcuuugugaauccugauacggggagaguucuauucgaauguaagcugcacaaauccggcuacgugacagucgcacauaccggacagcacgaccucgugauucccccaaacggcuauuuuagguucgauucauggguaaaccaauucuacacucuggccccgauggggaauggaaccggucggcgacgcguguga

SEQ ID NO: 20287 - RNA, 1620 nt, Artificial Sequence
  derived and/or modified sequence opt3 from VP1__Norovirus_and/or_Norovirus-like__KX354132
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccaguugaaugacucaaccauuaagcucaucgcuaugcuguauacaccacugcgugccaacaacgcgggggaugacguguucacugucagcugcagaguucucaccaggcccaguccggauuuugacuucaucuuuuuagugccucccacaguagaaucccggaccaaaccauucucugugccuauucugacugucgaggaaaugacaaauagccgcuuucccauaccacuugagaaguuguucaccggacccuccucagccuucgugguucagccucagaacgguagauguacgacugauggcgugcugcuagggaccacacaacucaguccagucaauauuugcacuuuuaggggagacaucacccauacaaccggcagccacaacuacacgaugaaucuggcaucucagaacuggaacuccuaugauccgacugaggaaauucccgcuccucuugguacaccagacuucguggggaaaauccagggaguacugacccagacuacacgggccgacggcucaacccgcggccauaaggcuacgguuuacaccgggagcgccgauuuugcacccaaguugggacgagugcaauucgagacagacacuaaucacgauuuugaagccaaucagaacaccaaauucacaccugucggugugauccaggacggcgggacuacccacagaaaugagccacaacaguggguccuccccaguuacucuggaaggaacacacauaaugugcaccuggcuccggcgguugcaccuaccuuuccaggcgaacaguuacuguucuuucgguccacuaugcccgguuguagcggguauccuaacauggaucucgacugccuucugccccaggagugggugcaauucuuuuaccaggaggccgcuccagcccagucggauguagcauugcuacguuucgucaauccugacacgggccgcgugcuguuugaauguaagcuccauaaaucuggauauguuacaguggcccacaccggccagcacgaucuggucauucccccaaacggguacuucagauucgacuccugggugaaccaauuuuauacucuugcuccgaugggaaaugguaccggcaggcggcgaguauga

SEQ ID NO: 20288 - RNA, 1620 nt, Artificial Sequence
  derived and/or modified sequence opt3 from VP1__Norovirus_and/or_Norovirus-like__KX354006
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaagucccugcuccacuggguacucccgacuucguggggaagauacagggaaugcuuacacagaccacucgcacagacggcuccacccgaggccacaaggccacggucuacaccgggucagcugauuuuacaccuaagcugggaaggauucaauucgagacugacaccgaucaugacuuugaagccaaucagaacacaaaauucacuccaguggguguuauccaggauggcagcaccacacacagaaaugagccccaacaguggguguugccgaguuacucugggcggaacacccacaauguacaucucgcauccgccgucgcuccuacuuuuccaggagaacagcuguuauucuuucguagcacgaugcccggcuguucggguuauccuaacauggaccuggauugccuccuuccccaggagugggugcaauacuucuaucaggaggcggcaccagcccagucugacguugcucuguugcgcuuugugaauccugauacagggagaguccuauucgaauguaagcugcacaaauccggcuacgugaccguagccuauacuggacagcaugaccucgugauucccccaaacggcuacuuuagguucgauucauggguuaaccaauucuauacccuggcaccgauggggaauggaacaggucggcgacgcgucuga

SEQ ID NO: 20289 - RNA, 1620 nt, Artificial Sequence
  derived and/or modified sequence opt3 from VP1__Norovirus_and/or_Norovirus-like__KX354145
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacacacaauguucaucucgccccggcuguggcgccuaccuuuccaggagaacagcuguuauucuuucguagcacuaugcccggcuguucggguuauccuaacauggaccuggauugccuccuuccccaggaguggguacaauacuucuaucaggaggcagccccagcucagucugacgucgcccuguugcgcuuugugaauccugauacggggagaguucuauucgaauguaagcugcacaaauccggcuacgugacagucgcacauaccggacagcacgaccucgugauucccccaaacggcuauuuuagguucgauucauggguaaaccaauucuacacucuggccccgauggggaauggaaccggucggcgacgcguguga

SEQ ID NO: 20290 - RNA, 1620 nt, Artificial Sequence
  derived and/or modified sequence opt3 from VP1__Norovirus_and/or_Norovirus-like__KX354140
augaagauggccagcuccgacgcuucucccucagauggcagugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagagcaacgacaguaccauuaaguugaucgcuaugcucuauacaccacugcgugccaauaacgcgggggaugacguguucacugucuccugcagaguucugaccaggcccucuccggauuuugacuucauuuuucucgugccucccacaguagaaagccggaccaaaccauucuccgugccugucuuaacuguggaggaaaugacaaacucacgcuuucccaucccacuggagaaacuuuucaccggacccaguagcgccuucguugugcagccucagaaugguagauguacgacugauggcgucuugcuggggaccacacaacuaucuccagugaacauaugcacuuuuaggggagacguaacccauauuacaggcucccggaauuacaccaugaaccucgcaucacagaauuggaacaauuaugauccgacggaggaaauccccgcuccucuggccacuccagacuucguugguaagauucaggggaugcuuacacagaccacucgcacagacggaagcacccgaggccacaaggcuacgguguacaccggcagugccgauuuugcacccaagcuggggagaguccaauucgagacagacacugaucaugacuuugaagccaaccagaauaccaaauucacaccugugggagucauccaggaugguucuacuacccacaggaacgagccacaacaguggguguugcccuccuacagcggccggaauacacacaacguucaucucgcuccggcgguggcaccuaccuuuccaggggaacagcuguuauucuuucguucgacuaugcccggauguucuggcuauccuaauauggaccuggauugccuccuuccccaggaguggguacaauacuucuaucaggaggccgcuccagcccaguccgacgucgcacuguugcgcuuugugaacccugauacggguagaguucuauucgaauguaagcugcacaaaucaggguacgugacagucgcccauaccggccagcacgaccucgugauucccccaaauggauauuuuagguucgauaguuggguaaaccaauucuacacucuggcuccgaugggcaacgggaccggacggcgacgcguguga

SEQ ID NO: 20291 - RNA, 1620 nt, Artificial Sequence
  derived and/or modified sequence opt3 from VP1__Norovirus_and/or_Norovirus-like__KX354119
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccuaucuuaacugucgaggaaaugacaaauucccgcuuucccauaccacuggagaaacuuuucaccggacccucaagugccuucgugguucagccucagaacgguagauguacgacugauggcguguugcuggggaccacacaacuaagcccagucaauauuugcacuuuuaggggagacaucacccauauuacaggcucucacaacuacaccaugaaucucgcaucccagaacuggaacucauaugauccgacggaggaaauccccgcuccucuggguacuccagacuucguggggaagauccagggaguacuuacacagaccacucgggccgacggcagcacacgcggccauaaggcuaccguuuacacggggagugccgauuuugcacccaagcugggacgagugcaauucgagaccgacacaaaucacgauuuugaagccaaucagaacacuaaauucaccccugucggugugauucaggacggcgggacaacucacagaaaugagccacaacagugggucuugcccucuuacuccggaaggaacacccauaaugugcaccucgcuccggcgguugcaccuacauuuccaggcgaacagcuguuauucuuucggagcaccaugcccgguuguucgggguauccuaacauggaucuggacugccuccuuccccaggagugggugcaauucuuuuaccaggaggccgcuccagcccagucugauguagcacuguugcguuucgucaauccugacacuggccgcgugcuauuugaauguaagcugcauaaacccggauauguuacgguggcccacacaggccagcacgaucucgucauaccaccgaacggguacuucagauucgacuccugggugaaccaauuuuauacccuggcuccuaugggaaaugguacuggcaggcggcgaguauga

SEQ ID NO: 20292 - RNA, 1620 nt, Artificial Sequence
  derived and/or modified sequence opt3 from VP1__Norovirus_and/or_Norovirus-like__KX354018
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaauucgagacagacacugaucaugacuuuggugcaaaucagaacaccaaauucacaccugugggcgucauccaggaugggaguacuacccacaggaaugaaccacaacaguggguguugcccucuuacuccggacggaacacacacaauguucaucucgccccggcuguggcgccuaccuuuccaggcgagcagcuguuauucuuucguagcacuaugcccgguuguucgggguauccuaacauggaccuggauugccuccuuccccaggaauggguacaauacuucuaucaggaggcagccccagcucagucugacgucgcccuguugcgcuuugugaauccugauacgggcagaguucuauucgaguguaagcugcacaaauccggauacgugacagucgcacauaccggccagcacgaccucgugauucccccaaacggguauuuuagguucgauucauggguaaaccaauucuacacucuggccccgaugggaaaugguaccggccggcgacgcguguga

SEQ ID NO: 20293 - RNA, 1620 nt, Artificial Sequence
  derived and/or modified sequence opt3 from VP1__Norovirus_and/or_Norovirus-like__AB972499
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuaucguggacguccgccaacuggagccagugcuuauaccccugccugaugugcgaaacaauuuuuaucacuacaaccagucaaaugacagcaccaucaaguugauugcuaugcucuauacaccacugcgugccaacaacgcgggggaugacgucuucacuguuaguugcagagugcugaccaggcccuccccggauuuugacuucaucuuucucguaccucccacaguggaaucucggaccaaaccauucagcgucccuguguuaacuguugaggaaaugacaaauucccgcuuucccauuccacuggagaaacuuuucaccggacccucaagugccuucgugguccagccucagaacgguagauguacgacugauggcguguugcuggggaccacacaacuaagcccaguaaauaucugcacuuuuaggggagacguuacccauauaacaggcucucggaacuacaccaugaaucucgcaucccagaacuggaauaacuaugauccgacggaggaaauucccgcuccucuggguacuccagacuucguggggaagauccagggaaugcuuacacagaccacucgcacagacggcucaacccgaggccacaaggccacggucuacaccgggagcgcugauuuugcccccaagcugggaagagugcaauucgagacagacacugaucaugacuuugaagcaaaucagaacaccaaauucacaccugucggugugauucaggauggcaguacuacccacaggaaugagccacaacaguggguuuugcccucuuacuccgggcggaacacacacaaugugcaucucgccccggcuguagcgccuaccuuuccaggagaacagcuguuauucuuucguagcacuaugcccggcuguucggguuauccuaacauggaccuggauugccuccuuccccaggaguggguccaauacuucuaucaggaggcagccccagcucagucugacguggcccuguugcgcuuuguuaauccugauacggggagagugcuauucgaauguaagcugcacaaauccggcuacgucacaguggcacauaccggacagcacgaccucguaauucccccaaacggcuauuuuagguucgauucaugggugaaccaauucuacacucuggccccgauggggaauggaaccggucggcgacgcguuuga

SEQ ID NO: 20294 - RNA, 1620 nt, Artificial Sequence
  derived and/or modified sequence opt3 from VP1__Norovirus_and/or_Norovirus-like__KF060142
augaagauggccagcuccgacgcuaaccccucugauggcucagcagccaaucuggugccugaggucaacaaugaaguuauggcgcucgacccagugguaggggcugccaucgcagccccgguggcuggacagcaaaacgucaucgaucccuggauaagaaauaacuucgugcaggcaccugguggcgaguuuaccguuaguccaaggaaugcccccggggaaauccuuuggagcgcuccucugggaccagacuugaaccccuacuuaucccaccuggcccggauguauaauggcuacgcggguggguucgaggugcaggucauucuagcaggaaacgccuuuacagcuggcaaaaucauuuucgccgcagugccuccaaauuuuccgacugaaggccucucucccucgcagguaacgauguucccucauaucauaguugaugugcgccaacuggagccaguccuuaucccccugccugacgugcgaaacaauuuuuaucacuacaaccagucaaaugauagcaccauuaaguugaucgcuaugcucuauacaccacugcgugccaacaacgcgggggacgauguguucacugucaguugcagaguucugaccaggcccuccccggacuuugauuucauuuuucucgugccucccacaguagagucucggaccaaaccauucagcgugccugucuuaacuguggaagagaugacaaauucccgcuuucccaucccacuggaaaaacuuuucaccggacccucaagugccuucguugugcagccucagaacgguagauguacgacugacggcgucuugcuggggaccacacaacuaagcccagugaauauaugcacuuuuaggggagauguaacccauauuacaggcucucggaacuacaccaugaaucucgcaucccagaacuggaauaacuaugacccgacggaggagauccccgcuccucuggguacuccagacuucguugggaagauucagggaaugcuuacacagaccacucgcacagauggcucaacccgaggccacaaggccacgguguacaccgggagcgcugacuuugcccccaagcugggaagaguccaauucgaaacagauacugaccaugauuuugaggcaaaucagaacaccaaauucacaccugugggugucauccaggacggcaguacuacccacaggaaugaaccacaacaguggguguugcccucuuacuccgggcggaacacacacaauguucaucucgccccggcuguggcgccuaccuuuccaggagagcagcuguuauucuuucguagcacuaugcccggcuguucggguuauccuaacauggaucuggacugccuccuuccccaggaauggguacaauacuucuaucaggaggcagccccagcucagucugaugucgcccuguugcgcuuugugaauccugacacggggagaguucuauucgaguguaagcugcacaaauccggcuacgugacagucgcacauaccggacagcacgaucucgugauucccccaaacggcuauuuuagguucgacucauggguaaaccaauucuacacucuggccccgauggggaauggaaccggucggcgacgcguguga

SEQ ID NO: 20295 - RNA, 1620 nt, Artificial Sequence
  derived and/or modified sequence opt3 from VP1__Norovirus_and/or_Norovirus-like__KF060138
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaaacgccuucguugugcagccucagaaugguagauguacgacugauggcgucuugcuggggaccacacaacuaaguccagugaacauaugcacuuuuaggggagacguaacccauauuacaggcagccggaauuacaccaugaaccucgcaucucagaauuggaacaauuaugauccgacggaggaaauccccgcuccucuggguacuccagacuucguugggaagauucagggaaugcuuacacagaccacucgcacagacggcuccacccgaggccacaaggccacgguguacaccgggucagcugauuuugcccccaagcugggaagaguccaauucgagacagacacugaucaugacuuugaagcaaaccagaauaccaaauucacaccugugggugucauccaggauggcagcacuacccacaggaacgagccacaacaguggguguugcccaguuacucugggcggaauacacacaacguucaucucgccccggcuguggcgccuaccuuuccaggagaacagcuguuauucuuucguuccacuaugcccggcuguagcgguuauccuaauauggaccuggauugccuccuuccccaggaguggguacaauacuucuaucaggaggcagccccagcucagucggacgucgcccuguugcgcuuugugaacccugauacggggagaguucuauucgaauguaagcugcacaaaucuggcuacgugacagucgcacauaccggacagcacgaccucgugauucccccaaacggcuauuuuagguucgauuccuggguaaaucaauucuacacucuggccccgauggggaacggaaccggucggcgacgcguguga

SEQ ID NO: 20296 - RNA, 1620 nt, Artificial Sequence
  derived and/or modified sequence opt3 from VP1__Norovirus_and/or_Norovirus-like__KP784697
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcagacccuccaaauuuuccgacugagggccucucucccucgcagguaacgauguucccucauaugauuguugaugugcgccaacuggagccaguccuuaucccccugccugacgugcgaaacaauuuuuaucacuacaaccagucaaaugauccaaccuugaagcucauagcuaugcuguauacaccccugcgugccaacaacgcgggggacgauguguucacugucagcugcagaguucucaccaggccgaguccugacuuugauuucaucuuuuuagugcccccaacaguagaaucccggaccaaaccuuucucugugcccauucugacugucgaggaaaugacaaauagccgcuuuccaaucccccuugagaaguuguucaccggaccuuccucagccuucgugguucagccacagaacgguagauguacgacugacggcgugcugcuagggaccacacaacucaguccggucaauauuugcacuuuuaggggagauaucacccauauaacaggcagccggaacuacaccaugaaucuggcaucucagaacuggaauaacuaugaccccacggaggaaauuccugcuccacuugguacucccgacuucguggggaaaauccagggaaugcugacacagaccacucgcacagauggcuccacccgaggccacaaggccacgguauacaccgggucagcugacuuugccccuaaguugggaagaguucaauucgagacagauacugaccaugauuuugaagcaaaucagaacaccaaauucacaccagugggugucauucaggacggcagcacuacccacaggaaugagccccaacagugggugcucccgaguuacucugggcggaacacacacaauguccaucuggccccugcuguggcgccaaccuuucccggagaacaguuacuguucuuucguuccacuaugccuggcuguagcgguuaucccaacauggaucucgacugccuucugccacaggaguggguucaauacuucuaucaggaggcagccccugcucagucggauguggccuugcuacgcuuuguaaaucccgacacggggagaguccuguucgaauguaagcuccacaaaucuggcuacgugacaguugcacauaccggacagcacgaucuggugaucccaccgaacggcuauuuuagguucgacuccugggucaaccaauucuacacucuugccccuauggggaauggaaccggucggcgacgcguguga

SEQ ID NO: 20297 - RNA, 1620 nt, Artificial Sequence
  derived and/or modified sequence opt3 from VP1__Norovirus_and/or_Norovirus-like__KF060111
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcgggacuacccacaggaaugagccacaacaguggguguugcccaguuacucuggacggaacacacacaauguucaucucgccccggcuguggcgccuaccuuuccaggcgaacagcuguuauucuuucguuccacuaugcccgguuguagcggguauccuaacauggaccuggauugccuccuuccccaggaguggguacaauacuucuaucaggaggcagccccagcucagucggacgucgcccuguugcgcuuugugaauccugauacgggcagaguucuauucgaauguaagcugcacaaaucuggauacgugacagucgcacauaccggccagcacgaccucgugauucccccaaacggguauuuuagguucgauuccuggguaaaccaauucuacacucuggccccgaugggaaaugguaccggccggcgacgcguguga

SEQ ID NO: 20298 - RNA, 1620 nt, Artificial Sequence
  derived and/or modified sequence opt3 from VP1__Norovirus_and/or_Norovirus-like__KF060089
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaucccacuggagaaacuuuucaccggacccucaagugccuucgucgugcagccucagaacgguagauguacgacugauggcguauugcuggggaccacacaacuaagcccaguuaauauuugcacuuuuaggggagacgugacccauaucacaggcucucggaacuacaccaugaaucucgcaucccagaacuggaauaacuaugauccgacggaggaaauacccgcuccucuggguacuccagacuucgucgggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccuguggguguuauccaggauggcaguacuacccacaggaaugagccacaacaguggguguugcccucuuacuccgggcggaacacacacaauguacaucucgccccggcugucgcgccuaccuuuccaggagaacagcuguuauucuuucguagcacuaugcccggcuguucggguuauccuaacauggaccuggauugccuccuuccccaggagugggugcaauacuucuaucaggaggcagccccagcucagucugacguugcccuguugcgcuuugugaauccugauacggggagaguccuauucgaauguaagcugcacaaauccggcuacgugacaguagcacauaccggacagcacgaccucgugauucccccaaacggcuauuuuagguucgauucauggguuaaccaauucuacacucuggccccgauggggaauggaaccggucggcgacgcgucuga

SEQ ID NO: 20299 - RNA, 1620 nt, Artificial Sequence
  derived and/or modified sequence opt3 from VP1__Norovirus_and/or_Norovirus-like__KP096333
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucauaguucagccacagaacgguagauguacuaccgauggcguguugcuggggacaacucaacuaaguccggucaauauuugcaccuuuaggggagacgugacacauaucagcggcucucggaacuacaccaugaaucucgccucccagaacuggaacucauaugaucccacggaggaaacuccugcaccacuggguacacccgacuucguagggaagauucagggaguucuuacccagacuacacgcaccgacggcagcacgcgaggccacaaggcuaccguguacacagggagugccgauuuuucuccuaagcugggaagaguccaauucgcuacugacaccgauaaugacuuugugacaaaucagaacacuaaauucaccccagucggugugauccaggauggcuccacaacccccaggaaugagccgcaacaguggguuuugccuagcuacucggggcggaacacucauaaugugcaccucgccccagcaguagcccccacguuuccuggagaacagcuguuauucuuucguucuacaaugcccggcuguuccgguuauccaaacauggaccuggauugccuccuuccucaggaguggguccaauacuucuaucaggaagcugcgcccgcacagucagacguggcccuguugcgcuuuguuaauccagauaccgggagagugcuauucgaguguaagcugcacaaaacuggcuacgucaccguggcucauacaggacagcacgaccucguaaucccgccuaacggcuauuuuagguucgauaguugggugaaccaauucuacacccuggcccccauggggaauggaacuggucggcgacgcguuuga

SEQ ID NO: 20300 - RNA, 1620 nt, Artificial Sequence
  derived and/or modified sequence opt3 from VP1__Norovirus_and/or_Norovirus-like__KF060153
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaaguggaggucauucuagcaggaaacgccuuuacagcuggcaaaaucauuuucgccgcagugccuccaaauuuuccgacugagggccucucucccucgcagguaacgauguucccucauaucauaguugacgugcgccagcuggaaccaguccuuaucccccugccugaugugcgaaacaauuuuuaucacuacaaccaaucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagagucucggaccaaaccauucagcgugccugucuuaacuguggaagagaugacaaauucccgcuuucccaucccacuggagaaacuuuucaccggacccucaagugccuucguugugcagccucagaacgguagauguacgacugauggcgucuugcuggggaccacacagcuaagcccagugaauauaugcacuuuuaggggagacguaacccauauuacaggcucucggaacuacaccaugaaucucgcaucccaaaacuggaauaacuaugauccgacggaagagauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaguucgaaacagacacugaucaugacuuugaggcaaaucaaaacaccaaauucacaccugugggugucauccaggauggcaguacuacccacaggaaugaaccacagcaauggguguugcccucuuacuccgggcggaacacacacaauguucaucucgccccggcuguggcgccuaccuuuccaggagagcagcuguuauucuuucguagcacuaugcccggcuguucggguuauccuaacauggaccuggauugccuccuuccccaggaguggguacaguacuucuaucaagaagcagccccagcucagucugacgucgcccuguugcgcuuugugaauccugauacggggagaguucuauucgaguguaagcugcacaaauccggcuacgugacagucgcacauaccggacagcacgaccucgugauucccccaaacggcuauuuuagguucgauucauggguaaaccaguucuacacucuggccccgauggggaauggaaccggucggcgacgcguguga

SEQ ID NO: 20301 - RNA, 1620 nt, Artificial Sequence
  derived and/or modified sequence opt3 from VP1__Norovirus_and/or_Norovirus-like__KF060125
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaaguggaggucauucuagcaggaaacgccuuuacagcuggcaaaaucauuuucgccgcagugccuccaaauuuuccgacugagggccucucucccucgcagguaacgauguucccucauaucauaguugacgugcgccagcuggaaccaguccuuaucccccugccugaugugcgaaacaauuuuuaucacuacaaccaaucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagagucucggaccaaaccauucagcgugccugucuuaacuguggaagagaugacaaauucccgcuuucccaucccacuggagaaacuuuucaccggacccucaagugccuucguugugcagccucagaacgguagauguacgacugauggcgucuugcuggggaccacacagcuaagcccagugaauauaugcacuuuuaggggagacguaacccauauuacaggcucucggaacuacaccaugaaucucgcaucccaaaacuggaauaacuaugauccgacggaagagauccccgcuccucuggguacuccagacuucguugggaagauucagggaacacuuacccagacuacacgcaccgacggcucaacgcgaggccacaaggccaccguguacacagggagcgcugauuuugcccccaagcugggaagaguccaguucgaaacugacaccgaucaugacuuugaggcaaaucaaaacacaaaauucacuccugugggugucauccaggauggcaguaccacacacaggaaugaaccacagcaauggguguugcccucuuacuccgggcggaacacccacaauguucaucucgccccggcuguggcgccuacuuuuccaggagagcagcuguuauucuuucguagcacgaugcccggcuguucggguuauccuaacauggaccuggauugccuccuuccccaggaguggguacaguacuucuaucaagaagcagccccagcucagucugacgucgcccuguugcgcuuugugaauccugauacagggagaguucuauucgaguguaagcugcacaaauccggcuacgugaccgucgcacauacuggacagcacgaccucgugauucccccaaacggcuauuuuagguucgauucauggguaaaccaguucuacacccuggccccgauggggaauggaacaggucggcgacgcguguga

SEQ ID NO: 20302 - RNA, 1620 nt, Artificial Sequence
  derived and/or modified sequence opt3 from VP1__Norovirus_and/or_Norovirus-like__KX354135
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccuaucuuaacugucgaggaaaugacaaauucccgcuuucccauaccacuggagaagcuguucaccggacccucaagugccuucgugguucagccucagaacgguagauguacgacugauggcguguugcuggggaccacacaacuaagcccagucaauauuugcacuuuuaggggagacaucacccauauuacaggcucucacaacuacaccaugaaucucgcaucccagaacuggaacucauaugauccgacggaggaaauccccgcuccucuggguacuccagacuucguggggaaaauccagggaguacuuacacagaccacucgggccgacggcagcacacgcggccauaaggcuaccguuuacacggggagugccgauuuugcacccaagcugggacgagugcaauucgagaccgacacaaaucacgauuuugaagccaaucagaacacuaaauucaccccugucggugugauucaggacggcgggacaacucacagaaaugagccacaacagugggucuugcccucuuacuccggaaggaacacccauaaugugcaccucgcuccggcgguugcaccuacauuuccaggcgaacagcuguuauuccuuaagagcaccaugcccgguuguucgggguauccuaacauggaucucgacugccuucugccccaggagugggugcaauuuuucuaccaggaggccgcuccagcccagucugauguagcauugcuacgguuugucaauccugacacuggccgugugcuguucgaauguaaacuccauaaguccggauauguuacgguggcccacacaggccagcacgaucuggucauacccccaaacggguacuuucgcuucgacucaugggugaaccaauucuauacccuugcuccgaugggaaaugguacuggcagaaggcggguauga

SEQ ID NO: 20303 - RNA, 1620 nt, Artificial Sequence
  derived and/or modified sequence opt3 from VP1__Norovirus_and/or_Norovirus-like__KX354045
augaagauggccagcuccgacgcuaaccccucugauggcucagcagccaaucuggugccugacgucaacaaugagguuauggcgcucgaaccagugguaggggcugccaucgcagccccgguggcuggacagcaaaacgucaucgaucccuggauaagaaauaacuucgugcaggcaccugguggcgaguuuaccguuaguccaaggaaugcccccggggaaauccuuuggagcgcuccucugggaccagacuugaaccccuacuuaucccaccuggcccggauguauaauggcuacgcggguggguucgaggugcaggucgugcuagcaggaaacgccuuuacagcuggcaaaauuaucuucgccgcaguaccuccaaauuuuccgacugaaggccucucucccucgcagguuacgauguucccucauauuaucguggauguccgccaacuggagccagugcuuauaccccugccugacgugcgaaacaauuuuuaucacuacaaccagucaaaugauagcaccaucaaguugauugcuaugcucuauacaccacugcgugccaacaacgcgggggacgaugucuucacuguuaguugcagagugcugaccaggcccuccccggacuuugauuucaucuuucucguaccucccacaguggagucucggaccaaaccauucagcgucccuguguuaacuguugaagagaugacaaauucccgcuuucccauuccacuggaaaaacuuuucaccggacccucaagugccuucgugguccagccucagaacgguagauguacgacugacggcguguugcuggggaccacacaacuaagcccaguaaauaucugcacuuuuaggggagauguuacccauauaacaggcucucggaacuacaccaugaaucucgcaucccagaacuggaauaacuaugacccgacggaggagauucccgcuccucuggguacuccagacuucguggggaagauccagggaaugcuuacacagaccacucgcacagauggcucaacccgaggccacaaggccacggucuacaccgggagcgcugacuuugcccccaagcugggaagagugcaauucgaaacagauacugaccaugauuuugaggcaaaucagaacaccaaauucacaccugucggugugauucaggacggcaguacuacccacaggaaugaaccacaacaguggguuuugcccucuuacuccgggcggaacacacacaaugugcaucucgccccggcuguagcgccuaccuuuccaggagagcagcuguuauucuuucguagcacuaugcccggcuguucggguuauccuaacauggaucuggacugccuccuuccccaggaauggguccaauacuucuaucaggaggcagccccagcucagucugauguggcccuguugcgcuuuguuaauccugacacggggagagugcuauucgaguguaagcugcacaaauccggcuacgucacaguggcacauaccggacagcacgaucucguaauucccccaaacggcuauuuuagguucgacucaugggugaaccaauucuacacucuggccccgauggggaauggaaccggucggcgacgcguuuga

SEQ ID NO: 20304 - RNA, 1620 nt, Artificial Sequence
  derived and/or modified sequence opt3 from VP1__Norovirus_and/or_Norovirus-like__LC153121
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaauucauaucaccggcucucggaacuacacaaugaaucucgcaucccagaacuggaauaacuaugauccgaccgaggaaauucccgcuccucuggguacgccagacuucguugggaagauccagggaaugcuuacucagacaacccgcacugacggcucaacacgaggccacaaggccaccguguacacggggagcgcugauuuugcccccaagcugggaagaguccaauucgagaccgacacagaucaugacuuugaagcaaaucagaacacuaaauucaccccugugggugucauccaggauggcaguacaacucacaggaaugagccacaacaguggguguugcccucuuacuccgggcggaacacccacaauguucaucucgccccggcuguggcgccuacauuuccaggagaacagcuguuauucuuucguagcaccaugcccggcuguucggguuauccuaacauggaccuggauugccuccuuccccaggaguggguacaauacuucuaucaggaggcagccccagcucagucugacgucgcccuguugcgcuuugugaauccugauacugggagaguucuauucgaauguaagcugcacaaauccggcuacgugacggucgcacauacaggacagcacgaccucgugauucccccaaacggcuauuuuagguucgauucauggguaaaccaauucuacacccuggccccgauggggaauggaacuggucggcgacgcguguga

SEQ ID NO: 20305 - RNA, 1620 nt, Artificial Sequence
  derived and/or modified sequence opt3 from VP1__Norovirus_and/or_Norovirus-like__KF668568
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaauuccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaugacccaaccaucaaguugauugcuaugcucuauacaccccugcgugccaacaacgccgggggagaugucuucacuguuagcugcagagugcugaccaggccgaguccugacuuugauuucaucuuucucguacccccaacaguggaaucccggaccaaaccuuucucuguccccguguuaacuguugaggaaaugacaaauagccgcuuuccaauuccccuggagaaacuuuucaccgguccuuccucagcguucgugguccagccacagaacggcagauguacgacugacgggguguugcugggaaccacacaacuaaguccgguaaauaucugcacuuuuaggggcgauguuacccauauaacagguagccggaacuacaccaugaaucucgcaucucagaacuggaauaacuaugaccccacggaggaaauuccugcuccacuggggacucccgauuucgugggaaagauccagggcaugcuuacacagaccacucgcacagacggcuccacccgagggcacaaggccacggucuacaccggaucagcugacuuugccccuaagcuggguagagugcaauucgagacagauacugaccaugauuuugaagcaaaucagauuaccaaauucacaccaaucggcgucauccaggacgggagcacuacccacaggaacgagccccaacaguggguguugccgaguuacucuggacggaauacacacaacguucaucucgccccugcuguggcgccaaccuuucccggcgaacagcuguuauucuuucguuccacuaugccugguuguagcggguaucccaauauggaucuggacugccuccuuccacaggaguggguacaauacuucuaucaggaggcagccccugcucagucggaugucgcccuguugcgcuuugugaaccccgacacgggcagaguucuauucgaauguaagcugcacaaaucuggauacgugacagucgcacauaccggccagcacgaucucgugauuccaccgaauggguauuuuagguucgacuccuggguaaaccaauucuacacucuggccccuaugggaaacgguaccggccggcgacgcguguga

SEQ ID NO: 20306 - RNA, 1620 nt, Artificial Sequence
  derived and/or modified sequence opt3 from VP1__Norovirus_and/or_Norovirus-like__KF668567
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuagcacugugaguugcagaguacugaccaggccguccccugauuucgacuuuauuuuccucgugcccccaacagucgaaucucggaccaaaccuuuuagcgugcccguuuuaacuguggaggaaaugacaaauucccgcuucccaaucccccuggagaaacuuuuuaccggaccuucaagugccuucgucgugcagccacagaacgguagauguacgacugauggcguauugcuggggaccacacaacuaagcccgguuaauauuugcacuuucaggggagacgugacccauaucacaggcucucggaacuacaccaugaaucucgcaucccagaacuggaauaacuaugaucccacggaggaaauaccugcuccacuggguacucccgacuuugucgggaagauucagggaaugcuuacacagaccacucgcacagacggcucaacccgaggccacaaggccacgguguacaccgggagcgcugauuucgccccuaagcugggaagaguccaauuugagacagacacugaucaugacuucgaagcaaaucagaacaccaaauuuacaccaaucggugugauucaggauggcaguacuacccacaggaaugagccccaacaguggguuuugccgucuuacuccgggcggaacacacacaaugugcaucucgccccugcuguagcgccaaccuuccccggagaacagcuguuauuuuuccguagcacuaugccuggcuguucggguuaucccaacauggaccuggauugccuccuuccacaggaguggguccaauacuuuuaucaggaggcagccccugcucagucugacguggcccuguugcgcuucguuaaucccgauacggggagagugcuauuugaauguaagcugcacaaauccggcuacgucacaguggcacauaccggacagcacgaccucguaaucccaccgaacggcuauuucagguuugauucaugggugaaccaauucuacacucuggccccuauggggaauggaaccggucggcgacgcguuuga

SEQ ID NO: 20307 - RNA, 1620 nt, Artificial Sequence
  derived and/or modified sequence opt3 from VP1__Norovirus_and/or_Norovirus-like__KR904210
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucgccggcucucggaacuacaccaugaaucucgcaucccagaacuggaacucauaugauccgacggaggaaauucccgcuccucuggagacuccagacuucguagguaagauccaggggguucuuacacagaccacucgcacagacggaagcacccgaggccacaaggccacgguguacaccggcagugcugauuuuucucccaagcuggggagaguccaauucgccacagacacugauaaugacuuugauuccaaucagaacaccaaauucacaccugugggagucauccaggacgguggcacuacccauaggaaugaaccacaacaguggguguugcccagcuacucggggcgggauauucacaacguucaccucgcaccggccguggcuccuacauuuccaggagagcagcuguuauucuuucguucuaccaugcccggcuguuccgguuauccuaauauggaccuggauugccuccuuccccaggaauggguacaauacuucuaucaggaggcggcaccagcccagucagacgucgcucuguugcgcuuugugaacccugauacugggagaguucuauucgaguguaagcugcauaaaaguggcuacgugacggucgcccacacaggacagcaugaccucgugauacccccaaauggcuauuuuagguucgacagcuggguaaaccaauucuacacccuggcaccgauggggaacggaacuggucggcgacgcguguga

SEQ ID NO: 20308 - RNA, 1620 nt, Artificial Sequence
  derived and/or modified sequence opt3 from VP1__Norovirus_and/or_Norovirus-like__JX459907
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaucccacuggagaaacuuuucaccggacccucaagugccuucgucgugcagccucagaacgguagauguacgacugauggcguauugcuggggaccacacaacuaagcccaguuaauauuugcacuuuuaggggagacgugacccauaucacaggcucucggaacuacaccaugaaucucgcaucccagaacuggaauaacuaugauccgacggacgagauacccgcuccucuggguacuccagacuucgucgggaagauucagggaaugcuuacacagaccacucgcacagauggcucaacccgaggccacaaggccacgguguacaccgggagcgcugacuuugcccccaagcugggaagaguccaauucgaaacagauacugaccaugauuuugaggcaaaucagaacaccaaauucacaccuguggguguuauccaggacggcaguacuacccacaggaaugaaccacaacaguggguguugcccucuuacuccgggcggaacacacacaauguacaucucgccccggcugucgcgccuaccuuuccaggagagcagcuguuauucuuucguagcacuaugcccggcuguucggguuauccuaacauggaucuggacugccuccuuccccaggaaugggugcaauacuucuaucaggaggcagccccagcucagucugauguugcccuguugcgcuuugugaauccugacacggggagaguccuauucgaguguaagcugcacaaauccggcuacgugacaguagcacauaccggacagcacgaucucgugauucccccaaacggcuauuuuagguucgacucauggguuaaccaauucuacacucuggccccgauggggaauggaaccggucggcgacgcgucuga

SEQ ID NO: 20309 - RNA, 1620 nt, Artificial Sequence
  derived and/or modified sequence opt3 from VP1__Norovirus_and/or_Norovirus-like__KF060062
augaagauggccagcuccgacgcuaaccccaccgauggcucugcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaacgcgggggaugacguguucaccgucagcugcagaguucugacaaggcccaguccggauuuugacuucauuuuucucgugccucccaccguagaaucccggacuaaaccauucucugugccugucuuaacaguggaggaaaugaccaauagccgcuuucccaucccacuggagaaacuuuucacgggacccuccucagccuucguugugcagccucagaacgguagauguacuaccgauggcgucuugcuggggacaacucaacuaaguccagugaauauaugcaccuuuaggggagacguaacacauauuaccggcagccggaacuacacgaugaaucucgcaucucagaacuggaauaacuaugauccgacugaggaaacacccgcuccucuggguaccccagacuucguugggaagauccagggaaugcuuacucagacaacccgcacggacggcuccacccgaggccacaaggccacaguguacacugggucagcugauuuugcccccaagcugggaagaguccaauucgagaccgacacagaucaugacuuugaagcaaaucagaacacuaaauucaccccugugggugucauucaggauggcagcacaacccacaggaaugagccacaacaguggguguugcccaguuacucugggcggaacacucacaauguucaucucgccccggcuguggcgccuacguuuccaggagaacagcuguuauucuuucguuccacaaugcccggcuguagcgguuauccuaacauggaccuggauugccuccuuccccaggaguggguacaauacuucuaucaggaggcagccccagcucagucggacgucgcccuguugcgcuuugugaauccugauaccgggagaguucuauucgaauguaagcugcacaaaucuggcuacgugacugucgcacauaccggacagcacgaccucgugauucccccaaacggcuauuuuagguucgauuccuggguaaaccaauucuacacacuggccccgauggggaauggaaccggucggcgacgcguguga

SEQ ID NO: 20310 - RNA, 1620 nt, Artificial Sequence
  derived and/or modified sequence opt3 from VP1__Norovirus_and/or_Norovirus-like__KF060080
augaagauggccagcuccgacgcuaaccccucugauggcucagcagccaaucuggugccugaggucaacaaugaaguuauggcgcucgagccaguggcuggggccgcaaucgccgcuccgguagcaggacagcaaaacgugauugaccccuggauaagaaauaacuucguccaggccccugguggcgaauuuaccgugaguccaaggaaugcucccggggagauccuuuggagcgccccucugggaccagauuugaaccccuacuuaucccaccuggcgcggauguauaauggcuacgccgguggguucgaaguucaggugauucuagcaggaaacgcuuuuacagccggcaaagucaucuucgcagcugugccuccaaauuuuccgacugagggccucucucccucgcagguaacgauguucccucauauuguuguggacguccgccaacuggagccagugcuuaucccccugccugaugugcgaaacaauuuuuaucacuacaaccagucaaaugacagcaccauaaaguugaucgccaugcucuauacaccacugcgugcgaacaacgccggggaugacgucuucacuguuaguugcagagugcugaccaggcccuccccggauuuugacuucauuuuucucguaccucccacaguggaaucucggaccaaaccauucagcgucccuguguuaacuguugaggaaaugacaaauucccgcuuucccaucccacuggagaaacuuuucaccggacccucaagugcauucgugguccagccucagaacgguagauguacgacugauggcguguugcuggggaccacacaacuaagcccaguaaauauuugcacuuuuaggggagacguuacccauaucacaggcucucggaacuacaccaugaaucucgcuucccagaacuggaauaacuaugauccgacggaggaaauacccgccccucuggguacuccagacuucguggggaagauucagggaaugcuuacacagaccacucgcacagacggcucaacccgaggccacaaggcuacggucuacaccgggagcgccgauuuugcacccaagcugggaagagugcaauucgagacagacacugaucaugacuuugaagccaaucagaacaccaaauucacaccugucggugugauccaggauggcaguacuacccacaggaaugagccacaacaguggguuuugcccucuuacuccgggcggaacacacacaaugugcaucucgcuccggcgguagcaccuaccuuuccaggagaacagcuguuauucuuucguagcacuaugcccggcuguucggguuauccuaacauggaccuggauugccuccuuccccaggaguggguccaauacuucuaucaggaggccgcuccagcccagucugacguggcacuguugcgcuuuguuaauccugauacggggagagugcuauucgaauguaagcugcacaaauccggcuacgucacaguggcccauaccggacagcacgaccucguaauucccccaaacggcuauuuuagguucgauucaugggugaaccaauucuacacucuggcuccgauggggaauggaaccggucggcgacgcguuuga

SEQ ID NO: 20311 - RNA, 1620 nt, Artificial Sequence
  derived and/or modified sequence opt3 from VP1__Norovirus_and/or_Norovirus-like__KF378731
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuugcugccggcaaaaucauuuucgcagcugugccuccaaauuuuccgacagagggccucucucccucgcagguaacuauguucccucauaucauaguugacgugcgccaacuggagccaguccuuaucccccugccugaugugcgaaacaauuuuuaucacuacaaccagucaaaugacagcacgauuaaguugaucgccaugcucuauaccccacugcgugcgaacaacgccggggaugacguguucacagucaguugcagaguucugacuaggcccuccccggauuuugacuucauuuuucucgugccucccaccguagaaucucggacaaaaccauucagcgugccugucuuaaccguggaggaaaugacuaauucccgcuuucccaucccacuggagaaacuuuucacaggacccucaagugcauucguugugcagccucagaacgguagauguaccacggauggcgucuugcuggggacuacccaacuaagcccagugaauauaugcacacucaggggagacguaacucauauuaccggcucucggaacuacacaaugaaucuggcuucccagaacuggaauaacuaugauccgaccgaggaaauccccgccccucuugguacgccagacuuuguugggaagauucagggaaugcugacucagacaacccgcacugacggcucaacacgaggcuacaaggcuaccguguacacggggagcgccgauuucgcacccaaguugggaagaguccaauuugagaccgacacagaucacgacuucgaagccaaucagaacacuaaauuuaccccugugggugucauccaggauggcaguacaacucauaggaaugagccacaacagugggugcuccccucuuauuccgggcggaacacccacaauguucaccuggcuccggcgguggcaccuacauucccaggagaacaguuacuguuuuuccguagcaccaugcccggcuguucggguuacccuaacauggaccucgauugccuucugccccaggaguggguacaauauuuuuaccaggaggccgcuccagcccagucugacgucgcauugcuacgcuucgugaauccugauacugggagaguucuguuugaauguaagcuccauaaauccggcuaugugacggucgcccacacaggacagcaugaccuggugauucccccaaacggcuacuucagguuugauucauggguaaaccaauucuauacccuugcuccgauggggaauggaacuggucggcgacgcguguga

SEQ ID NO: 20312 - RNA, 1620 nt, Artificial Sequence
  derived and/or modified sequence opt3 from VP1__Norovirus_and/or_Norovirus-like__AB933731
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagcaagguuuccccaaucccccugaaaaaguuguuuacgggaccuucaagugcguucgugguccagccacagaacggucgcuguacuaccgauggcgugcuucuggggacaacucaacuaagcccgguaaauauaugcaccuucagaggagacguuacacauauucccggcucuaggaacuacaccaugaaucucgccucccagaacuggaacucauaugauccuacggaggagaucccagcaccccuggguacuccugacuuuguggggaagauucagggaguccuuacacagaccacucggacaaauggcagcacccgcggccacaaagcuacgguguacaccgggagugccgacuucucuccaaagcugggacgaguccaauuugcuacagauacugacaaugauuucgaaaccaaccagaauacaaaauuuacucccguggguguuauccaggacggcuccaccacaccgagaaacgagccucaacaguggguguugccaagcuacucggggaggaauauccauaacguacaccucgcccccgcagucgccccuaccuuccccggagaacagcuguuauuuuuccggucuacuaugccaggcuguuccgguuauccuaauauggaucuggacugccuccuuccccaggagugggugcaauacuuuuaucaggaagcugcgccagcacagucagauguugcccuguugcguuucgugaacccggacacggggcgcguccuauuugaguguaagcugcacaaaaguggcuacgugacaguagcucauaccggacagcacgaucucgugauuccucccaacggcuauuucagauuugacagcuggguuaaucaauucuacacucuggccccaauggggaacggaaccgguaggcggcgauga

SEQ ID NO: 20313 - RNA, 1620 nt, Artificial Sequence
  derived and/or modified sequence opt3 from VP1__Norovirus_and/or_Norovirus-like__AB933749
augaagauggccagcaacgacgugaaucccuccgauggcucuaccgcuaaccuggucccugagguuaauaacgaagugauggcacucgagccaguagugggggccgcgaucgcugccccggucgcaggacagcaaaaugugauugaccccuggauaagaaacaauuucguucaggccccugguggcgaauuuacagugucaccaaggaacgcucccggggagauccuuuggagugcaccucugggaccagauuugaaucccuacuuaagccaccuggcccggauguauaacggcuacgcugguggguucgaaguccaggugauucuagccggaaaugcguuuacugcaguaguucgcaucauuuucuccgccgugccuccaaacuuuccgacggagggccucucucccucgcaggucaccauguucccucauaucauaguggacgugcgacaacuggagccaguccuuaucccccugccugauguucguaauaacuuuuaucacuacaaucagucaaacgacagcacaauuaaauugaucgcuaugcucuauacuccacugagagccaacaaugcaggcgaugacguguucaccguaaguugcagggugcugacacggcccuccccggauuuugacuucauuuuucucgucccucccaccguggaaucucgcacuaagccauucagcguuccuguguuaacagucgaggaaaugaccaacuccagauuucccaucccacuggagaaacuuuucacggggcccucaagugcuuucgugguacagccucagaauggaagguguacuaccgaugguguuuugcugggcacaacucaacuaagcccagugaacauaugcaccuuucgcggggacgucacacauauuucuggaucccggaauuacaccaugaaccucgccucacagaauuggaacagcuaugauccgacggaggaaauccccgcgccucugggcacuccagacuucguggguaagauucaggggguccuuacacagaccacucgaacaaauggaaguaccagaggccacaaagccacgguguacaccggcucugcagacuuuucccccaagcuggggaggguucaauucgcuacagauacugacaacgauuuugagaccaaucagaacacaaaguucacuccugugggaguaauccaggacgguagcaccacaccacggaaugaaccccaacagugggucuugccgucguacucuggccguaacauccauaaugugcaccucgccccugcuguugccccaaccuuucccggggagcagcuguuauucuuucgcuccacuaugccuggauguucaggcuaucccaacauggaucuggacugccuccuuccacaggaaugggugcaauacuucuaucaggaggcagccccugcucagagugaugucgcgcuguugagauuugugaaccccgacacggguaggguacuauucgaguguaaacugcacaagagcggguacgugacaguugcacauaccggccagcacgaucucgucauuccaccgaauggauauuuucgguucgacuccugggugaaccaauucuacacucuggccccuaugggcaaugggaccggacgacgcagauga

SEQ ID NO: 20314 - RNA, 1620 nt, Artificial Sequence
  derived and/or modified sequence opt3 from VP1__Norovirus_and/or_Norovirus-like__KC517370
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuucuaauuuuccaacugagggccucucgccgucacagguuacgauguucccccauauuaucguggacguccgccaacuggagccugugcuuauaccacugcccgaugugcgaaacaauuuuuaucacuacaaccagagcaaugacaguaccaucaaguugauugcuaugcucuauacacugcugcgugccaacaacgcgggggaugacgucuucacuguuuccugcagagugcucaccaggccuucuccagauuuugacuucaucuuuuuaguacccccgacaguggaaagccggaccaaaccuuucuccguccccgugcugacuguugaggaaaugacaaauucacgcuuuccaauuccucuugagaaguuguucaccggacccaguagcgccuucgugguccagccacagaacgguagauguacgacugauggcgugcugcuagggaccacacaacucucucccguaaauaucugcacuuuuaggggagacguuacccauauaacaggcucccggaacuacaccaugaaucuggcaucacagaacuggaauaacuaugauccuacggaggaaauuccagcuccgcuugguacucccgacuucguggggaaaauccagggaaugcugacacagaccacucgcacagacggcagcacccgaggccacaaggccacgauguacaccgggagugcugauuuugccccuaaguugggaagaguccaauucgagacagacacugaucaugacuuugaagcaaaucagaacaccaaauucacaccagugggugucauucaggauggcgggacuacccacaggaaugagccccaacagugggugcucccuucuuacuccggacggaacacacacaauguucaucuggccccagcuguggcgcccaccuuuccgggcgaacaguuacuguucuuucguccuacuaugccagguuguagcggguaucccaacauggaccucgaucgccuucugccucaggaguggguacaauacuucuaucaggaggcagcccccgcucagucggacgucgccuugcuaagauuugugaauccagauacgggcaggguucuguucgaaugcaagcuccacaaaucuggauacgugacagucgcacauaccggccagcacgaccuggugaucccucccaacggguauuuucgguucgauuccuggguaaaccaauucuacacucuugccccaaugggaaaugguaccggccgacgcagaguguga

SEQ ID NO: 20315 - RNA, 1620 nt, Artificial Sequence
  derived and/or modified sequence opt3 from VP1__Norovirus_and/or_Norovirus-like__EF547396
augaugauggccagcaaggacgcucccaccaacauggauggcacauccggggcaggacagcuggugccugaggccaauacugcggaaccaaucucuauggacccggucgcuggugccgcaacggccguugcuaccgcaggccaaauuaacaugauagaucccuggaucaugucaaauuucgugcaggccccucagggggaguuuacaguaaguccaaacaauacucccggagacgugcuguucgaucuucagcugggcccucaauugaacccauuuuuagcucaccuggcccagauguacaaugguugggucgggaacaugagagugaaaguucuacucgcgggaaaugcauucaccgccggcaagauuaucauuagcugcauacccccuggcuuuacaucccagaacaucucuaucgcucagaugaccauguucccacaugugauugccgacgucagggugcuggaaccgaucgagguaccccuugaagauguucggaaugugcuguuucacacuaacgacaaucgcccuacaaugcgauuggucuguaugcucuauaccccacugcgugcaaacgggucgucaagcggaacggaucccuucgugauugcugguagagugcugacuugcccugacaguaauuuuuccuuccucuuuuuagucccacccaacguugagcagaaaaccaggccguucucugugccuaacaucccccugaauacacuuagcaacucccggguaccaucauugauaaagaguaugacuauuagccgcgaucaaaaucagaucauucaguuucaaaacggcagagugacccuggacgggcagcuacagggaacaaccccuacgucugucucccaacucuguaaaaucaggggcacuacauaccaugccaccggugggaauggaaucaaccugacugagcuuaauggcgaacccuaucacgcguucgagucaccagcccccauuggcuucccugaucucgggggaugcgacuggcauuugacagcaaccccaacgcaggcuuuuaacgacggugccaaggugguucggcucagcgugacccagggcgcugccuucgcaccgcaccuggggacaauacacuacacuaccacagauacugacuauagucccaauaccucuaucauuuguacauuagauuggcugucccagaccacuggacaaagcaacgucgacccuuggcagaucccaacguacggcucgacacucaccgaagccgcucagcuugcgcccccuauauuuccacccgguuucggggagacucugguguuuuucuugucugauuuuccgauuuccaauggcaagaacggacuaucaguaccuugcacccugccacaggaguucguuacacauuuugugaaugaacaagcacccauccgcggcgaggccgcucuccugcacuaugucgacccugauacccaucgaaaccuuggggaguucaaacuguaccccgaaggauuuaugacuugugugccaaauacaagugguggcgggccucagacguugcccaucaacggagucuucguguuuguuagcuggguguccagauucuaccagcucaagccaguaggcaccgccggugcagccaggcggcuguga

SEQ ID NO: 20316 - RNA, 1620 nt, Artificial Sequence
  derived and/or modified sequence opt3 from VP1__Norovirus_and/or_Norovirus-like__JN699047
augaugauggccagcaaggacgcucccaccaacauggauggcacauccggggcaggacagcuggugccugaggccaauacugcggaaccaaucucuauggacccggucgcuggugccgcaacggccguugcuaccgcaggccaaauuaacaugauagaucccuggaucaugucaaauuucgugcaggccccucagggggaguuuacaguaaguccaaacaauacucccggagacgugcuguucgaucuucagcugggcccucaauugaacccauuuuuagcucaccuggcccagauguacaaugguugggucgggaacaugagagugaaaguucuacucgcgggaaaugcauucaccgccggcaagauuaucauuagcugcauacccccuggcuuuacaucccagaacaucucuaucgcucagaugaccauguucccacaugugauugccgacgucagggugcuggaaccgaucgagauuccccuugaagauguacggaauguucuguuucacacuaacgacaaucgcccuacaaugcgauugguguguaugcucuauaccccacugcgugcaaacgggucgucaagcggaacggaucccuucgucaucgcugguagagugcugacuugcccugacaguaauuuuuccuuccucuuuuuagugccacccaacgucgagcagaaaaccaggccguucucuguuccuaacauaccccugaauacacuuagcaacucccgggugccaucauugauuaagaguaugacuaucagccgcgaucaaaaucagauuauccaguuucaaaacggcagaguaacccuggacgggcagcuacagggaacaaccccuacgucugugucccaacucuguaaaaucaggggcacuacauaccaugccaccggugggaauggaauuaaccugacugagcuuaauggcgaacccuaucacgcguucgagucaccagcccccauaggcuucccugaucucgggggaugcgacuggcauuugacagcaaccccaacgcaggcuuuuaacgacggugccaaggucgugcggcucagcguuacccagggcgcugccuucgcaccgcaccuggggacaauccacuacacuaccacagaucaugacuaugaucccaauaccaguauuaucuguacuuuagacuggcugucucagacaaccggacaaaacaauguggauccuuggcagauaccaacuuacggcuccacgcucacagaagccgcucagcuugcgcccccuauuuuuccacccgguuucggggagacccuggucuuuuucuugagcgacuuuccgaucucgaacggcaagaauggacuaucugugccuugcacucugccacaggaguucguaacccacuuuguuaacgaacaagcacccauccgcggcgaggccgcucuccugcauuauguggauccugacacacaccgaaaucuuggggaguucaaacuguaccccgaaggauuuaugaccugugucccaaacacuuccgguggcgggccucagacauugcccauuaacggaguguucgucuuugugucauggguuaguagauucuaccagcucaagccagugggcacggccggugcagccaggcggcuguga

SEQ ID NO: 20317 - RNA, 1620 nt, Artificial Sequence
  derived and/or modified sequence opt3 from VP1__Norovirus_and/or_Norovirus-like__KT781411
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauauucucuuugaccuucagcugggcccucacuugaauccauucuuaagucaucuggcccaaauguauaacgguuggguagggaauaugaaagugaagguccuacucgcgggaaacgcauuuaccgccggcaaaaucauuaucagcugcauacccccuggcuucgcuucccagaauaucucuauugcccaggcaacaauguuuccacacgugaucgcugauguuagagugcuggaaccgauugaagucccccuugaggacgugaggaacguacuguuccauaauaacgauaauucgccuaccaugcgguugguuuguaugcucuacacuccacugcgcgccucagggagcaguuccggaacagaccccuuugugaucgcgggucgaguccugaccugcccuucuccagauuucagcuuucucuucuuagugcccccgaacguggagcagaagacgaaaccuuuuuccguccccaaccugccacuuaauacuuugucaaacagucguguuccuagccugauaaaugccaugaugauuucuagagaccacggccaaauggugcaguuccagaacgggaggguaacccuagauggacagcuccaaggcacaacucccaccucccugucacagcuuuguaagauccgggguaagguguuucuggcaagcgggggaaauggcuugaaccucacagaacuggacggcagugcuuaucaugccuucgagucuccagcucccauuggguucccugauaucggagacugcgacuggcacaugaaugccaccgcaacguccaacuuuacugguagcaaugaugaacaccagaucuuagucaaacaagagucgacauucgccccacaucugggccacgugcaggcugaccaucucccggagguugcgaacaccgaucuuauggugucucuguccuggauuucacccgucagugaccagcaccgcagagauguggacccuuggguaauaccaagguacgggagcacuuugacagaagcagcccagcuagcucccccuaucuauccacccggauuuggcgaggccauuguuuucuuuauguccgauuucccgguggucucuggugugaaugggaugcggaucccuuguacccugccacaagaauacgucgcacacuuugugaacgagcaggcccccacgcgcggcgaagcugcccuccugcauuauguugacccugauacccaccgaaaucuuggagaguucaagauauaccccgagggcuuuaugacaugcgugccaaacagcucagggacuggaccucagacccugcccauuaaugguguauucacauuugucaguuggguguccagauucuaccaguugaaaccaguuggcacugcagggccggcgaggcggcucuga

SEQ ID NO: 20318 - RNA, 1620 nt, Artificial Sequence
  derived and/or modified sequence opt3 from VP1__Norovirus_and/or_Norovirus-like__U04469
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugucaaauuacgugcaggcuccucagggggaguucacaaucaguccaaacaauacucccggagauauucucuuugaccuucagcugggcccucacuugaacccauucuuaagccaucuggcccaaauguauaaugguuggguagggaacaugagagugaaaguccuacucgcgggaaaugcauuuaccgccggcaagaucauuaucuccugcauacccccuggcuucgcugcccagaacaucucuauugcacaggcuacaauguuuccacacgugaucgccgauguuagggugcuggaaccgauugaagucccccuugaggacgugcggaauguacuguuccauaacaaugauucgucaccuaccaugcgcuugguuuguaugcucuacacuccacugcgagcgagcgggaguuccucuggaacagaccccuuugugaucgccggucguguccugaccugcccuagcccagauuucuccuuucucuucuuagugcccccgaacguggagcagaaaacgaagccuuuuucaguccccaaucugccacuuaacacuuugaguaacagcagaguuccuucucugauaaaugcaaugaugauuuccagggaccacggccaaauggugcaguuccagaacgggcggguaacccuagauggacagcuccaaggcacaacucccaccucacugagccagcuuuguaaaauccgcgguaagguguuucaugcuagugggggaaauggccugaacuugacagaacucgacggcucugccuaucacgcuuucgaguccccagcccccauuggguucccugauaucggagacugcgacuggcacaugagcgcaaccgccacgaauaacuuuacugguucgucuaaugaauaccagauccugauuaagcaagaguccgcuuucgcgccacauuuaggccacguccaggcagauaaccugucagccggggcuaauacagaccucauagugagucuuagcuggaucuccccgguuucugaucagcauagacacgacguggaucccugggucauuccuagguauggaagcucacugaccgaggccgcacaguuggccccacccaucuacccuccaggcuuuggugaagcuauaguguucuuuaugagugacuuccccguaguuuccggggugaacggcaugcggauuccguguacucuaccucaagaguaugucgcccacuuugugaaugaacaggcaccaacacgcggagaggcggcucugcuccauuacgucgaucccgacacccaccgaaaccugggcgaguucaaaauguacccugaaggguuuaugacgugcgugcccaauagcucuggaucagguccacagacccuuccuaucaacggcguuuucacauuugugaguuggguaagcagauucuaucagcugaagcccgucgggacugccggaccagcaaggcgguuguga

SEQ ID NO: 20319 - RNA, 1620 nt, Artificial Sequence
  derived and/or modified sequence opt3 from VP1__Norovirus_and/or_Norovirus-like__JN699049
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauauucucuuugaccuucagcugggcccucacuugaauccauucuuaagucaucuggcccaaauguauaacgguuggguagggaauaugaaagugaagguccuacucgcgggaaacgcauuuaccgccggcaaaaucauuaucagcugcauacccccuggcuucgcuucccagaauaucucuauugcccaggcaacaauguuuccacacgugaucgcugauguuagagugcuggaaccgauugaagucccccuugaggacgugaggaacguacuguuccauaauaacgauaauaccccuacuaugcgguugguuuguaugcucuacacaccacugcgcgccucggggucaagcaguggaaccgaccccuuugugaucgcgggucgaguccugacgugcccuuccccagauuucucuuuucucuucuuagugcccccgaacguggagcagaagacuaaaccuuuuagcguccccaaccugccacuuaauguuuuguccaacucacgugugccuagucugauaaaguucaugaugguaagccaagaccacggccagauggugcaguuucagaaugggagagucacccuagauggacaacuccagggcacaacucccaccucugccucccagcuguguaagaugagggguacaguguaucaugcaucagggggacaaggccuuaaccugaccgaaauugacggcacgccauaccacgcuuucgagagccccgccccuaucggguucccagauuugggagacagugacuggcacauuaaugcuucuccggccacuacauuuaacaccggugaauccguuaaacggcucgauauggagcagggcagcucguucgcaccccaucuggggacugugcacuauacaaaugccgacuacgaugcuaacaccgacuuaaucugcucucuggaguggcucuccccuccaucaggaggcacgcccaauaaggucaacccuugggcgaucccacgcuaugguaguacccuuacagaagcagcccagcuggcucccccgauuuacccuccaggguuuggcgaggccauaguguucuuuaugagcgauuuccccaucgcaaauggacaggacggcuugaaaguaccuuguacuauuccccaagaauuuguuacccauuucgugaacgagcaggccccaacaagaggggaagcugcccuacugcacuacgucgauccugacacucacaggaaucucggagaguuuaagcuguaucccgaggguuucaugaccugcgugccaaacuccucuggcagcgggccgcagacacuuccuaucaauggagucuuuaccuucgugucauggguuagucgguuuuaccagcugaaacccgugggcacuacggguccaguacgccgauuguga

SEQ ID NO: 20320 - RNA, 1620 nt, Artificial Sequence
  derived and/or modified sequence opt3 from VP1__Norovirus_and/or_Norovirus-like__GQ856473
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauauucucuuugaccuucagcugggcccucacuugaauccauucuuaagucaucuggcccaaauguauaacgguuggguagggaauaugaaagugaagguccuacucgcgggaaacgcauuuaccgccggcaaaaucauuaucagcugcauacccccuggcuucgcugcccagaauaucuccauugcacaggcuacaauguuuccacacgugaucgccgauguuagagugcuggaaccgauugaagucccccuugaggacgugaggaacguacuguuccauaauaacgauaauucuccuaccaugcgguugguuuguaugcucuacacuccacugcgcgcgucggggucaagcaguggaacagaccccuuugugaucgccggucgaguccugaccugcccuuccccagauuucucuuuucucuucuuagugcccccgaacguggagcagaagacgaaaccuuuuagcguccccaaccugccacuuaauacuuuguccaacucacguguuccuagucugauaaaugcaaugaugauuagcagagaccacggccaaauggugcaguuccagaacgggaggguaacccuagauggacagcuccaaggcacaacucccaccucucugucccagcuuuguaagauccgggguaagguguuucaugcuucagggggaaauggccugaacuugacagaacucgacggcagcgccuaucacgcuuucgagaguccagcccccauuggguucccugauaucggagaaugcgacuggcacaugaaugcaaccgccacgucuaacuuuacugguuccaaugacgaguaccagauccuggucaaacaagagagcacauucgcuccacauuuaggccacgugcaggcggauucgcugucugcagacgccaacaccgaucucaugguuucccuuucauggauuaguccggugagcgaccagcaucgcagagaugucgaccccugggugauaccuagguauggguccucucugacugaagcugcccaguuggcaccacccaucuacccuccaggauuuggcgaggccauuguauucuuuaugagcgauuuccccguugugucaggugucaaugggaugcggaucccguguacacuaccucaagaauauguggcucacuuugucaacgagcaggccccaacccgcggcgaagcagcgcugcuccacuacguggaccccgauacgcaucgaaaucugggagaguucaagauguacccugagggcuuuaugaccugcguucccaacaguuccgggagcggaccacagacacuuccuauaaauggugugcugacuuucguaucuugggucucaagauuuuaucaguugaaacccgugggcaccgcugggccagccaggcggcucuga

SEQ ID NO: 20321 - RNA, 1620 nt, Artificial Sequence
  derived and/or modified sequence opt3 from VP1__Norovirus_and/or_Norovirus-like__JN699050
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauauucucuuugaccuucagcugggcccucacuugaauccauucuuaagucaucuggcccaaauguauaacgguuggguagggaauaugaaagugaagguccuacucgcgggaaacgcauuuaccgccggcaaaaucauuaucagcugcauacccccuggcuucgcuucccagaauaucucuauugcccaggcaacaauguuuccacacgugaucgcugauguuagagugcuggaaccgauugaagucccccuugaggacgugaggaacguacuguuccauaauaacgauaauaccccuacuaugcgguugguuuguaugcucuacacaccacugcgcgccucggggucaagcaguggaaccgaccccuuugugaucgcgggucgaguccugacgugcccuuccccagauuucucuuuucucuucuuagugcccccgaacguggagcagaagacuaaaccuuuuagcguccccaaccugccacuuaauguuuuguccaacucacgugugccuagucugauaaagagcaugaugguaucucaagaccacggccagauggugcaguuccagaaugggagagucacccuagauggacaacuccagggcacaacucccaccuccgccucacagcuguguaagaugagggguacaguguaucaugcaagcgggggacaaggccuuaaccugaccgaaauugacggcacgccauaccacgcuuuugagagucccgccccuaucggguucccagauauuggagacucugacuggcacaucaaugcuuccccggccacuacauucgauagcggugaaucgaucaaacgguuggacauggagcaggggucuuccuuugcaccccaucucggcaccguucacuauacuaacgccgauuacccugcuaauacagaccugauuugcucauuagaguggcugaguccacccagcggaggcaccccuaacaaggugaauccauggacgauaccccgcuaugguuccacccucacagaagcggcacagcuugccccgccuaucuacccacccggguucggcgaggcuauugucuuuuucaugucugauuuuccuaucgccaacggacaggacggccugaaagugcccuguacuauaccacaagaguucguaacccauuuuguuaaugaacaggcaccuacaagaggggaagccgcuuugcuacacuacguggaucccgacacucacaggaaccugggagaguucaagcucuauccagaggguuuuaugaccugcgucccgaauagcucaggcagugggccucagacacugcccauuaacggaguguucaccuuugucuccugggugagccgguucuaccagcuuaaaccaguuggcacuacgggucccgugcgccgacuguga

SEQ ID NO: 20322 - RNA, 1620 nt, Artificial Sequence
  derived and/or modified sequence opt3 from VP1__Norovirus_and/or_Norovirus-like__GQ856472
augaugauggccagcaaggacgcucccaccaacauggauggcacauccggggcaggacagcuggugccugaggccaauacugcggaaccaaucucuauggacccggucgcuggugccgcaacggccguugcuaccgcaggccaaauuaacaugauagaucccuggaucaugucaaauuucgugcaggccccucagggggaguuuacaguaaguccaaacaauacucccggagacgugcuguucgaucuucagcugggcccucaauugaacccauuuuuagcucaccuggcccagauguacaaugguugggucgggaacaugagagugaaaguucuacucgcgggaaaugcauucaccgccggcaagauuaucauuagcugcauacccccuggcuuuacaucccagaacaucucuaucgcucagaugaccauguucccacaugugauugccgacgucagggugcuggaaccgaucgagauuccccuugaagauguacggaauguucuguuucacacuaacgacaaucgcccuacaaugcgauugguguguaugcucuauaccccacugcgugcaaacgggucgucaagcggaacggaucccuucgucaucgcugguagagugcugacuugcccugacaguaauuuuuccuuccucuuuuuagugccacccaacgucgagcagaaaaccaggccguucucuguuccuaacauaccccugaauacacuuagcaacucccgggugccaucauugauuaagaguaugacuaucagccgcgaucaaaaucagauuauccaguuucaaaacggcagaguaacccuggacgggcagcuacagggaacaaccccuacgucugugucccaacucuguaaaaucaggggcacuacauaccaugccaccggugggucaggaauuaaucugacugagcuuaacggcgaacccuaucacgcguucgagagcccagcccccauaggcuucccugaucucgggggaugcgacuggcauuugacagcaaccccaacgcaggcuuuuaaugacggugccaaggucgugcggcucaguguuacccagggcgcugccuucgcaccgcaccuggggacaauccacuacacuaccacagauacugacuauaaccccaauaccucuauuaucuguacauuagauuggcugucccagaccacuggacaaagcaacguggacccuuggcagauaccaacguacggcucggcccucacagaagcugcgcagcuugcacccccuauuuuuccacccgguuucggggagacccuggucuuuuucuugucugauuuuccgaucuccaauggcaagaacggacuaucagugccuugcacucugccacaggaguucguaacccauuuuguuaaugaacaagcccccauccgcggcgaggcugcccuccugcacuauguggacccugauacacaucgaaaccuuggggaguucaaacuguaccccgaaggauuuaugaccugugucccaaauacaagugguggcgggccucagacuuugcccauuaacggaguguucgucuuugugagcuggguuuccagauucuaccagcucaagccagugggcacggccggugcagcuaggcggcuguga

SEQ ID NO: 20323 - RNA, 1620 nt, Artificial Sequence
  derived and/or modified sequence opt3 from VP1__Norovirus_and/or_Norovirus-like__GQ856471
augaugauggccagcaaggacgcucccaccaacauggauggcacauccggggcaggacagcuggugccugaggccaauacugcggaaccaaucucuauggacccggucgcuggugccgcaacggccguugcuaccgcaggccaaauuaacaugauagaucccuggaucaugucaaauuucgugcaggccccucagggggaguuuacaguaaguccaaacaauacucccggagacgugcuguucgaucuucagcugggcccucaauugaacccauuuuuagcucaccuggcccagauguacaaugguugggucgggaacaugagagugaaaguucuacucgcgggaaaugcauucaccgccggcaagauuaucauuagcugcauacccccuggcuuuacaucccagaacaucucuaucgcucagaugaccauguucccacaugugauugccgacgucagggugcuggaaccgaucgagauuccccuugaagauguacggaauguucuguuucacacuaacgacaaucgcccuacaaugcgauugguguguaugcucuauaccccacugcgugcaaacgggucgucaagcggaacggaucccuucgucaucgcugguagagugcugacuugcccugacaguaauuuuuccuuccucuuuuuagugccacccaacgucgagcagaaaaccaggccguucucuguuccuaacauaccccugaauacacuuagcaacucccgggugccaucauugauuaagaguaugacuaucagccgcgaucaaaaucagauuauccaguuucaaaacggcagaguaacccuggacgggcagcuacagggaacaaccccuacgucugugucccaacucuguaaaaucaggggcacuacauaccaugccaccggugggucaggaauuaaucugacugagcuuaacggcgaacccuaucacgcguucgagagcccagcccccauaggcuucccugaucucgggggaugcgacuggcauuugacagcaaccccaacgcaggcuuuuaaugacggugccaaggucgugcggcucaguguuacccagggcgcugccuucgcaccgcaccuggggacaauccacuacacuaccacagauacugacuauaaccccaauaccucuauuaucuguacauuagauuggcugucccagaccacuggacaaagcaacguggacccuuggcagauaccaacguacggcucgacacucaccgaagccgcucagcuugcgcccccuauuuuuccacccgguuucggggagacucuggucuuuuucuugucugauuuuccgaucuccaauggcaagaacggacuaucagugccuugcacccugccacaggaguucguaacacauuuuguuaaugaacaagcacccauccgcggcgaggccgcucuccugcacuaugccgacccugauacccaucgaaaccuuggggaguucaaacuguaccccgaaggauuuaugacuugugugccaaauacaagugguggcgggccucagacguugcccauuaacggagucuucguguuugucagcuggguguccagauucuaccagcucaagccaguuggcaccgccggugcagcuaggcggcuguga

SEQ ID NO: 20324 - RNA, 1620 nt, Artificial Sequence
  derived and/or modified sequence opt3 from VP1__Norovirus_and/or_Norovirus-like__JQ911594
augaugauggccagcaaggacgcucccaccaacauggauggcacauccggggcaggacagcuggugccugaggccaauacugcggaaccaaucucuauggacccggucgcuggugccgcaacggccguugcuaccgcaggccaaauuaacaugauagaucccuggaucaugucaaauuucgugcaggccccucagggggaguuuacaguaaguccaaacaauacucccggagacgugcuguucgaucuucagcugggcccucaauugaacccauuuuuagcucaccuggcccagauguacaaugguugggucgggaacaugagagugaaaguucuacucgcgggaaaugcauucaccgccggcaagauuaucauuagcugcauacccccuggcuuuacaucccagaacaucucuaucgcucagaugaccauguucccacaugugauugccgacgucagggugcuggaaccgaucgagauuccccuugaagauguacggaauguucuguuucacacuaacgacaaucgcccuacaaugcgauugguguguaugcucuauaccccacugcgugcaaacgggucgucaagcggaacggaucccuucgucaucgcugguagagugcugacuugcccugacaguaauuuuuccuuccucuuuuuagugccacccaacgucgagcagaaaaccaggccguucucuguuccuaacauaccccugaauacacuuagcaacucccgggugccaucauugauuaagaguaugacuaucagccgcgaucaaaaucagauuauccaguuucaaaacggcagaguaacccuggacgggcagcuacagggaacaaccccuacgucugugucccaacucuguaaaaucaggggcacuacauaccaugccaccggugggaauggaauuaaccugacugagcuuaauggcgaacccuaucacgcguucgagucaccagcccccauaggcuucccugaucucgggggaugcgacuggcauuugacagcaaccccaacgcaggcuuuuaacgacggugccaaggucgugcggcucagcguuacccagggcgcugccuucgcaccgcaccuggggacaauccacuacacuaccacagauacugacuauaaucccaacaccaguauuaucuguacauuagauuggcugucucagaccgccggacaauccaauguggacccuuggcagauaccaacuuacggcagcacgcucacagaagcugcgcagcuugcacccccuauuuuuccacccgguuucggggagacccuggucuuuuucuugucggauuuuccgaucucuaacggcaagaauggacuauccgugccuugcacucugccacaggaguucguaacccauuuuguuaacgaacaagcccccauccgcggcgaggcugcccuccugcacuauguggacccugauacacaucgaaaucuuggggaguucaaacuguaccccgaaggauuuaugaccugugucccaaacacuucagguggcgggccucagacauugcccauuaacggaguguucgucuuugugaguuggguuagcagauucuaccagcucaagccagugggcacggccggugcagcuaggcggcuguga

SEQ ID NO: 20325 - RNA, 1620 nt, Artificial Sequence
  derived and/or modified sequence opt3 from VP1__Norovirus_and/or_Norovirus-like__GU296356
augaugauggccagcaaggacgcuaccuccaacauggauggcacaucuggggcaggacagcuggugcccgagaauaacaauacuucagaaccuaucaacauggagccagucgccggugcgguuacggcugccgcaaccgccggccaagugaauaugauugacccguggauaaugaacaauuacguacaggcuccccagggggaguucacaaucaguccuaacaauacuccaggagauauucucuuugaccuucagcugggcccccacuugaacccuuucuuagcacaucugagccaaauguauaaugguuggguggggaacaugaaagucagagugguucuagccggaaaugcuuuuuccgccggcaagaucauugugugcuguaucccacccggcuucucugcgccuaacauaucgaucgcacaggccaccauguuuccacacgucauugcugaugugaggguacucgaaccgaucgacauuccccuggaugacguucggaaugugcuuuuccauacaaacgauaacgggaaucagaccaugcgccuguugugcaugcucuacacuccucugcgaucaggagguacaagcaguggcaccgacccauuugucaucgccgggcgugugcugacgugucccacuccugauuucaacuuucucuucuuagugccacccaccgucgaacagaaaacaaagcaauuuuccguuccgaaucugccucuuaacgugaugucuaauagcagaguacccuccuugcugaacgcaaugguggucucaccagaccaggcucaggugguucaguuccaaaauggaaggugcacucuagauggccagaugcucgguaccacaaccgugagugccagcugugucgcgcgguuucgcgggaaaacguuccaggccccugacgacagacugggaauaaaccuugcagagauuucuggcgagcccuaucacgcuuucgaauccccagcuccccugggcuuuccugauuucggggacggagauuggcaugugacugccacaaagguagccccaucacaauuggaggcaaaugacccgguuguggucgguaacgugcagcccuacaauccucaguuugccccacaccucggcacccuggucguggaaaaccccacuccuaaucagguugcuacagggaccgauuuacuguucaacaucacguggcucagcaauagggcgaacaaccgguuuaauccauggauuauccccaacuauggaaguacccuuacagaggcagcccaacuggcuccgucuaucuucccuccaggcuuuggugagacuauuguguacuucaauuccaccuuucccgccguaggggcaacaacucacgccgcuauaccuugcuugcuaccccaggaguucgucgcccauuuugugaacgaacaggcaccaauccgcggcgaagcggcucugcuccacuauauugacccugauacccaucgaaaucugggagaguucaagaucuaccccgaaggcuuuguuacaugugugccaaacgucgggggaaccgguccgcagagccuuccuacuaauggcauauucguguucguaucgugggugucuagauacuaucaacugaaacccguugggacggccuga

SEQ ID NO: 20326 - RNA, 1620 nt, Artificial Sequence
  derived and/or modified sequence opt3 from VP1__Norovirus_and/or_Norovirus-like__KM461693
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagauaacauuucugcugcccagaucacuaugugcccgcacguuauaguggacguccgccagcuugaacccgugcuguugccucucccagauauccgaaauagauuuuuccauuauaaccaggaggacacgccccguaugaggcugguggcaaugcuguacaccccucuccgggcuaauucgggcgaagaugucuuuacaguuucaugucgcguguuaacuagaccagcccccgacuucgaguuuaccuuccugguaccgccuacaguggagagcaagaccaaacccuuuacucuuccaauuuugacacugggcgaacuaaguaacuccagguucccugcggccaucgauaugcucuauaccgaccccaacgagucuauugucgugcaaccacagaaugggcggugcacgcuggauggaacucuucaggguaccacacagcugguucccacucaaaucugugcauuucgcggcaccuugauaagccagaacgcucgagccgcugaccucacagauuccccucagagagccaggaaucacccacugcaugugcaagucaagaacuuagacgggacccaguacgacccgacggaugacauucccgcagugcugggagccaucgauuucaaaggcacuguauucgguguugcuucacagcgggacgugagugggacacaggaacaaggacacuaugcgacccgugcacacgaggcccauauugauacuacagacccuaaguacgcuccaaagcucggcaccauccuuaucaaaagcgaaucuacggauuuuaccacaaaucagcccauucgcuucacuccugucggcaugggggacaacaauuggagacagugggagcugccagauuacuccggaucauugacccuaaacaugaaucuggcccccgcagugagcccgaguuuuccuggugagaggauacucuucuuucggucuaucgucccauccgccggcggguauggaagcggcuacauugacugccugaucccccaggaaugggugcaacacuucuaucaggaggcugccccuucgcagucugcaguugcgcuugugcgauacguaaaccccgauacaggucgcaauauauuugaagcuaagcugcauagagagggguucuugacugucgccaacuccggcaauaacccaaugggagugccucccaauggcuauuuuagguucgaagcauggguuaaccaguuuuacacccucgccccauga

SEQ ID NO: 20327 - RNA, 1620 nt, Artificial Sequence
  derived and/or modified sequence opt3 from VP1__Norovirus_and/or_Norovirus-like__LC145789
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaaguucacccccgugggucugaacgauacagaccauuuuaaucaguggguugugccgcgauaugcaggcgccuugaaccuaaauacuaaccuggcuccuuccguagcgccagucuuccccggggaaagacuccuguuuuucaggucauacaucccucuuaaaggaggcuaugguacccccgcaauugauugccuguugccacaagagugggugcagcacuuuuaccaggaggccgcuccuagcaugagugaaguugcccucgugcgguauaucaaucccgacacagggcgugcacuguucgaggccaaguuacaccgcgcuggcuuuaugacugucucuuccaacaccagcgccccagugguagugccggcaaacggauacuucagauuugauucguggguuaaucaguucuauucucuggcgccuaugggcacagggaacggaaggcgguga

SEQ ID NO: 20328 - RNA, 1617 nt, Artificial Sequence
  derived and/or modified sequence opt3 from VP1__Norovirus_and/or_Norovirus-like__KX171417
augaagauggccagcaacgacgcugcacccuccaaugauggcgccgcggggcuggugccugagggaaacaaugaaacccucucucuugagccagucgcuggugccgcaaucgccgcuccgguuacaggccagaacaauauuauagaccccuggaucagaacuaacuucgugcaagcaccuaauggggaauuuacgguaucaccaaggaacagucccggagagauucuguugaauuuagaacugggcccugaucuaaacccauaccucgcccaccugagccggauguauaaugguuacgcugggggaguggagguccaggugcuucuggccggcaacgcguucaccgcaggcaaaaucuuguuugccgcuguucccccuaauuucccaguggaguuucucuccccggcccagauuacaaugcugccccaucugaucgucgacgugcgcacucucgaaccuauaaugaucccauuacccgauguacgaaacaccuucuuucacuauaauaaccagccuaacucucguaugagacugguugcaaugcuuuacacaccauugaggucgaaugggucaggagacgauguguucaccgucagcugccgggugcugacucgccccacaccggacuuugaguucaccuaucuagugccucccagugucgaauccaagacgaaaccauuuucucucccuauucugacucuuagcgagcugaccaacuccagauuccccguuccaaucgauucauuguuuacagcucaaaauaacgugcuccagguacagugucagaaugguaggugcacucuggacggcgaguuacaagggaccacacagcugcuccccaguggaauuugugccuuccggggccgcgugaccgcgaagacggaucauagcgacaaauggcacaugcagcuucagaaccugaaugguacuacauacgauccuaccgacgacgucccagccccguuggggacucccgauuucaagggagugguuuuuggcguggcaucucaacgaaacgucggcaaugacgcuccuggguccacaagagcccaugaagcugugaucucaaccuauagcccacaguucguacccaagcuaggaaguguuaacuuuaggucuaaugaugacgauuuccagcugcaaccuacgaaauuuaccccagugugcauaaacgacgaugacgaucaccccuuccggcagugggagcucccggacuacuccggucugcuuacacugaauaugaacuuggccccuccagucgcacccaauuuuccuggcgaacagcuccuguucuuucguagcuucgugcccuguucugggggauacaaccagggcauugucgauugcuuaaucccacaagaguggauucagcacuuuuaucaggaaucggccccuucccagucagagguggcucugauccgcuacguuaaccccgacacugguagaacccuauucgaggcgaagcuccauaggaguggguauaucacaguggcacacagcggcgacuacccacugguagucccggccaauggauauuuucgguucgauuccugggugaaccaauucuacucucuugcuccuaugggcacugggaauggacgacgcagagcccaguga

SEQ ID NO: 20329 - RNA, 1617 nt, Artificial Sequence
  derived and/or modified sequence opt3 from VP1__Norovirus_and/or_Norovirus-like__KX171412
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauaauaaccagccaaacucccguaugagacugguugcaaugcuuuacacacccuugaggucuaaugggucgggagacgauguguucaccgucucaugccgggugcugacucgcccgacaccugacuuugaguucaccuaucuagugcccccaagcgucgaaaguaagacgaaaccuuuuucccuccccauucugacucuuucugagcugaccaacagcagauucccaguucccaucgauuccuuguuuacagcucaaaauaacgugcuccagguacagugucagaaugguaggugcacucuggacggcgaguuacaagggaccacacagcugcucccuucaggaauuugugccuuccggggccgcgugaccgcggaaacggaucaucacgacaaguggcauaugcagcuucagaaccugaaugguacuacauacgauccaaccgacgacgucccggcccccuuggggacuccugauuucaaaggagugguuuuuggcguggcaagucaacgaaacgucggcaaugacgcuccagggagcacaagagcccacgaggcugugaucucuaccuauucaccccaguucguaccuaagcuaggauccguuaacuuuaggagcaaugaugacgauuuccagcugcaaccaacgaaguuuacccccguggguauaaacgacgauggcgaccacccguuccggcagugggaacucccugauuacagugggcugcuuacacugaauaugaacuuggccccacccgucgcaccuaauuuucccggagagcagcuccuguucuuucguucuuucgugccaugcuccggcgguuacaaccaggggauugucgacuguuuaaucccucaagaauggauucagcauuuuuaucaggagagcgcccccucgcagucugauguggcucugauccgcuacguuaacccagacacuggcagaacccuauucgaggcgaaacuccacagguccggauauaucacaguggcacauucaggcgacuacccgcugguagucccugccaauggguauuuucgguucgauaguugggugaaccaauucuacagccuugcucccaugggaacugguaauggccgacgcagagcccaguga

SEQ ID NO: 20330 - RNA, 1617 nt, Artificial Sequence
  derived and/or modified sequence opt3 from VP1__Norovirus_and/or_Norovirus-like__KU557839
augaagauggccagcaacgacgcugcacccuccucugauggcgccgcggggcuggugccugagggaaauaacgaaacccucccacuugagccggucgcuggugccgcaaucgccgcucccguuacaggccagaauaacauuauagacccuuggaucagaacuaauuucgugcaagcaccaaacggggaauuuacgguaucacccaggaauaguccuggagagauucuguugaacuuagaacugggcccagaucuaaaucccuaccucgcccaccugagccggauguauaacgguuacgcugggggaguggagguccaggugcuucuggccggcaaugcguucaccgcaggcaaaaucuuguuugccgcuguuccuccaaacuucccgguggaguuucucucccccgcccagauuacaaugcugccucaucugaucgucgacgugcgcacucucgaaccaauaaugauccccuuaccugauguacgaaauaccuucuuucacuauaacaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcggaaacggaucaucgagacaaguggcacaugcagcuucagaaucugaacgguacuacauacgauccaaccgacgacgucccggcccccuuggggacuccugauuucaaaggagugguuuuuggcguggcaagccaaagaaaugucggcaacgacgcuccagggucuacaagggcccaugaggcugugaucuccaccuauucaccccaguucguaccuaagcuaggaagcguuaauuuucggaguaacgauaaugacuuccagcugcaaccaacgaaguuuacccccguggguauaaacgaugacggcgaucacccguuccgucagugggaacucccugacuacucugggcugcuuacacugaauaugaacuuggccccacccgucgcaccuaauuuucccggagagcagcuccuguucuuucgcuccuucgugccaugcagcggcgguuacaaccaggggauugucgauuguuuaaucccucaagaauggauucagcacuuuuaucaggagucggcccccucucaguccgacguggcucugaucagauacguuaacccagauacuggcaggacccuauucgaggcgaaacuccaucggucaggauauaucacaguggcacacaguggcgacuacccgcugguagucccugccaauggguauuuucgauucgacagcugggugaaccaauucuacucccuugcucccaugggaacugguaauggccgcagaagggcccaguga

SEQ ID NO: 20331 - RNA, 1617 nt, Artificial Sequence
  derived and/or modified sequence opt3 from VP1__Norovirus_and/or_Norovirus-like__KP902564
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauaauaaccagccaaacucccguaugagacugguugcaaugcuuuacacacccuugaggucuaaugggucgggagacgauguguucaccgucucaugccgggugcugacucgcccgacaccugacuuugaguucaccuaucuagugcccccaagcgucgaaaguaagacgaaaccuuuuucccuccccauucugacucuuucugagcugaccaacagcagauucccaguucccaucgauuccuuguuuacagcucaaaauaacgugcuccagguacagugucagaaugguaggugcacucuggacggcgaguuacaagggaccacacagcugcucccuucaggaauuugugccuuccggggccgcgugaccgcggaaacggaucaucgagacaaguggcacaugcagcuucagaaccugaaugguacuacauacgauccaaccgacgacgucccggcccccuuggggacuccugauuucaaaggagugguuuuuggcguggcaagucaaagaaacgucggcaaugacgcuccagauagcacaagggcccaugaggcugugaucucuaccuauucaccccaguucguaccuaagcuaggguccguuaacuuucggagcaaugacaacgauuuccagcugcaaccaacgaaguuuacccccgugggaauaaaugacgauggugaccacccguuccgucagugggaacucccugauuacaguggccugcuuacacugaacaugaauuuggccccacccgucgcaccuaacuuucccggggagcagcuccuguucuuucgcucuuucgugccaugcuccggaggcuacaaccaggguauugucgacuguuuaaucccucaagaauggauucagcacuuuuaucaggagagcgcccccucgcagucugauguggcucugaucagauacguuaauccagacacugggaggacccuauucgaggcgaaacuccaucgguccggcuauaucacaguggcacacucaggagacuacccgcugguagucccugccaacggcuauuuucgauucgauaguugggugaaucaauucuacagccuugcucccauggggacuggaaacggucgcagaagggcccaguga

SEQ ID NO: 20332 - RNA, 1617 nt, Artificial Sequence
  derived and/or modified sequence opt3 from VP1__Norovirus_and/or_Norovirus-like__KU587625
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucauaucauagucgacgugcgcacucuggaaccaaucaugauuccccucccugauguacgaaacaccuucuuucacuauaauaaccagccaaacucccguaugagauuaguugcaaugcuguacacaccccuuaggucuaaugggucgggagacgauguguucaccgucucaugccggguguugacucgcccgacaccugacuuugaguucaccuaucuggugcccccaagcgucgaaaguaagacgaaaccuuuuucccuacccauccucacucugucugagcuuaccaacagcagauucccaguucccauugauucccuguuuacagcucaaaauaacguguugcagguacagugucagaaugguaggugcacucucgacggcgagcugcaagggaccacacaguuacugccuucaggaaucugugccuuccggggccgcgugaccgcggaaacggauaacccagacaaguggcauaugcagcuccagaaucuuaacgguacuacauacgauccgaccgacgacguccccgccccucuggggacuccagauuucaaaggagugguuuuuggcguggcaagucaacgaaaugucggcaacgacgcucccgggagcacaagagcccacgaggcugugauaucuaccuauuccccuaaguucguaccaaaguugggaucaguuaauuuuaggagcaacgaugacgauuuccagcuacagcccacgcgguuuaccccgguggguauuaaugacgauggcaaccauccuuuccgucaaugggaacugccagacuacagugggguccucacacugaauaugaaccuugcacccccuguggcccccaacuuuccaggagagcagcugcucuuguuccgcucuuuugucccuugcuccggcgguuacaaucaggggaucauugauugucugaucccccaggaauggauccaacacuucuaucaggagagcgccccaucgcagucugacguggcuuuaauuagauacguuaacccggauacuggcaggacccuguuugaggcgaaacuacaccgguccggauauauaacaguggcacauucaggcgacuacccucucguaguccccgccaauggguauuuccgauuugacaguugggugaaccaguucuacagccuggcuccaaugggaacugguaauggccgcagaagggcccaauga

SEQ ID NO: 20333 - RNA, 1617 nt, Artificial Sequence
  derived and/or modified sequence opt3 from VP1__Norovirus_and/or_Norovirus-like__KX171413
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauaauaaccagccaaacucccguaugagacugguugcaaugcuuuacacacccuugaggucuaaugggucgggagacgauguguucaccgucucaugccgggugcugacucgcccgacaccugacuuugaguucaccuaucuagugcccccaagcgucgaaaguaagacgaaaccuuuuucccuccccauucugacucuuucugagcugaccaacagcagauucccaguucccaucgauuccuuguuuacagcucaaaauaacgugcuccagguacagugucagaaugguaggugcacucuggacggcgaguuacaagggaccacacagcugcucccuucaggaauuugugccuuccggggccgcgugaccacggaaacugaucaucgagacaaguggcacaugcagcuucagaaccugaaugguacaaccuacgauccaacugacgacgucccggcgcccuuggggacaccugauuucaaaggagugguuuuuggcguggccagucaaagaaacgucggcaaugacgcaccagggagcaccagggcucaugaggccgugaucucuacguauucaccccaguucguaccuaagcuaggauccguuaacuuucggagcaaugaugacgauuuccagcugcaaccaaccaaguuuacacccguggguauaaacgacgauggcgaccacccguuccgucagugggaacucccugauuacagugggccacugacucuuaauaugaaccuggcucccccugucgcccccaauuuuccaggagagcagcucuuguucuuucgcucuuucgugccuugcuccggcgguuacaaccaggggauugucgacugucugaucccccaagaauggauucagcacuuuuaucaggagagcgcaccaucgcagucugauguggccuuaaucagauacguuaacccggacaccggcaggacacuguucgaggcuaaacuacaucgguccggauauaucacuguggcgcacucaggcgacuacccucucguaguccccgcaaauggguauuuucgauucgauaguugggugaaccaauucuacagccuggccccaaugggaaccgguaauggccgcagaagggcucaguga

SEQ ID NO: 20334 - RNA, 1617 nt, Artificial Sequence
  derived and/or modified sequence opt3 from VP1__Norovirus_and/or_Norovirus-like__KP902565
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauaauaaccagccaaacaaucguaugagacugguugcaaugcuuuacacacccuugagguccaacgggucuggagacgauguguucaccgucucgugccgggugcugacucgcccgacaccugacuuugaguucaccuaucuagugcccccaucagucgaaagcaagacgaaaccuuuuagucuccccauucugacucuuuccgagcugaccaauucuagauucccaguucccaucgauagcuuguuuacagcucaaaacaaugugcuccagguacagugucagaacgguaggugcacucuggacggcgaguuacaagggaccacacagcugcucccuuccggaauuugugccuuccggggccgcgugaccgcggaaacggaucaucgagacaaguggcacaugcagcuucagaaucugaacgguacuacauacgauccaaccgacgacgucccggcccccuuggggacuccugauuucaaaggagugguuuuuggcguggcaucacaaagaaaugucggcaacgacgcuccagggaguacaagggcccaugaggcugugaucagcaccuauucuccccaguucguaccuaagcuaggauccguuaauuuucggucaaacgauaaugacuuccagcugcaaccaacgaaguuuacccccguggguauaaacgaugacggcgaucacccguuccgucagugggaacucccugacuacagcgggcugcuuacacugaauaugaacuuggccccacccgucgcaccuaacuuucccggagagcagcuccuguucuuucgcaguuucgugccaugcucuggcgguuacaaucaggggauugucgauuguuuaaucccucaagaauggauucagcacuuuuaucaggaguccgcccccagccagucggacguggcucugaucagauacguuaacccagauacuggcaggacccuauucgaggcgaaacuccaucggucuggauauaucacaguggcacacuccggcgacuacccgcugguagucccugccaauggguauuuucgauucgacucaugggugaaccaauucuacagucuugcucccaugggaacugguaauggccgcagaagggcccaguga

SEQ ID NO: 20335 - RNA, 1617 nt, Artificial Sequence
  derived and/or modified sequence opt3 from VP1__Norovirus_and/or_Norovirus-like__KX171416
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauaauaaccagccaaacaaucguaugagacugguugcaaugcuuuacacacccuugagguccaacgggucuggagacgauguguucaccgucucgugccgggugcugacucgcccgacaccugacuuugaguucaccuaucuagugcccccaucagucgaaagcaagacgaaaccuuuuagucuccccauucugacucuuuccgagcugaccaauucuagauucccaguucccaucgauagcuuguuuacagcucaaaacaaugugcuccagguacagugucagaacgguaggugcacucuggacggcgaguuacaagggaccacacagcugcucccuuccggaauuugugccuuccggggccgcgugaccgcggaaacggaucaucgagacaaguggcacaugcagcuucagaaucugaacgguacuacauacgauccaaccgacgacgucccggcccccuuggggacuccugauuucaaaggagugguuuuuggcaucgcaucacaaagaaaugugggcaacgacgcuccagggaguacaagggcccaugaggcugucauaagcaccuauucuccccaguucgugccuaagcuaggauccguaaauuuucggucaaacgauaaugacuuccagcugcaaccaacgaaguuuacccccguugguauuaacgaugacggcgaucacccguuccgucagugggaacucccugacuacagcgggcugcuuacacugaauaugaacuuggccccacccguggcaccuaacuuucccggagagcagcuccuguucuuucgcaguuucgucccaugcucuggcgguuacaaucaggggaucguggauuguuuaauuccucaagaauggauccagcacuuuuaucaggaguccgcccccagccagucggacgucgcucugaucagauacgugaacccagauacuggcaggacccuauucgaggcgaaacuccaucggucuggauauauuacaguugcacacuccggcgacuacccgcuggugguaccugccaauggguauuuucgauucgacucaugggucaaccaauucuacagucuugcucccaugggaacugguaauggccgcagaagggcccaguga

SEQ ID NO: 20336 - RNA, 1617 nt, Artificial Sequence
  derived and/or modified sequence opt3 from VP1__Norovirus_and/or_Norovirus-like__KU561250
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauaauaaccagccaaacucccguaugagacugguugcaaugcuuuacacacccuugaggucuaaugggucgggagacgauguguucaccgucucaugccgggugcugacucgcccgacaccugacuuugaguucaccuaucuagugcccccaagcgucgaaaguaagacgaaaccuuuuucccuccccauucugacucuuucugagcugaccaacagcagauucccaguucccaucgauuccuuguuuacagcucaaaauaacgugcuccagguacagugucagaaugguaggugcacucuggacggcgaguuacaagggaccacacagcugcucccuucaggaauuugugccuuccggggccgcgugaccgcggaaacggaucaucgagacaaguggcacaugcagcuucagaaccugaaugguacuacauacgauccaaccgacgacgucccggcccccuuggggacuccugauuucaaaggagugguuuuuggcguggcaagucaaagaaacgucggcaaugacgcuccagggagcacaagggcccaugaggcugccaucucuaccuauucaccccaguucgugccuaagcuaggauccguaaacuuucggagcaaugauaacgacuuccagcugcaaccaacgaaguuuacccccguugguauaaaugaugacggcgaucacccguuccgucagugggaacucccugacuacagugggcugcuuacacugaacaugaauuuggcaccacccguggccccuaacuuucccggagagcagcuccuguucuuucgcucuuucgucccaugcuccggcgguuacaaccaggggauuguggauuguuuaaucccucaagaauggauucagcacuuuuaucaggagagcgcucccucgcagucugacgucgcgcugaucagauacgugaauccagauacuggcaggacccuauucgaggcaaaacuccaucgguccggauauaucacaguugcccacucaggcgacuacccgcuggugguaccugcuaacggguauuuucgauucgacaguugggucaaucaauucuacagccuugcccccaugggaacugguaacggccgcagaagggcacaguga

SEQ ID NO: 20337 - RNA, 1617 nt, Artificial Sequence
  derived and/or modified sequence opt3 from VP1__Norovirus_and/or_Norovirus-like__KU561251
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauaauaaccagccaaacucccguaugagacugguugcaaugcuuuacacacccuugaggucuaaugggucgggagacgauguguucaccgucucaugccgggugcugacucgcccgacaccugacuuugaguucaccuaucuagugcccccaagcgucgaaaguaagacgaaaccuuuuucccuccccauucugacucuuucugagcugaccaacagcagauucccaguucccaucgauuccuuguuuacagcucauaauaacgugcuccaaguacagugucagaaugguaggugcacucuggacggcgaguuacaggggaccacacaacugcucccuucaggaauuugugccuuccggggccgcgugaccgcggaaacggaucaccgagacaaguggcauaugcagcuucagaaccugaaugguacuacauacgauccaaccgacgacgucccggcccccuuggggacuccugauuucaaaggagugguuuuuggcguggcaagucagagaaacgucggcaaugacgcuccagggagcacaagggcccacgaggcugugaucucuaccuauucaccccaauucguaccuaagcuaggauccguuaacuuucggagcaaugauaacgacuuccagcugcagccaacgaaguuuacccccguggguauaaaugaugacggcgaucacccguuccgucaaugggaacucccugacuacagugggcugcuuacacugaacaugaauuuggccccacccgucgcaccuaacuuucccggagagcagcuccuguucuuucgcucuuucgugccaugcuccggcgguuacaaccaggggauugucgauuguuuaaucccucaggaauggauucaacauuuuuaucaggagagcgcccccucgcagucugacguggcucugaucagauacguuaauccagauacuggcaggacccuauucgaggcgaaacuccaccgguccggauauaucacaguggcacauucaggcgacuacccgcugguagucccugccaacggguauuuucgauucgacaguugggugaaucaguucuacagccuugcucccaugggaacugguaacggccgcagaaccgcccaauga

SEQ ID NO: 20338 - RNA, 1617 nt, Artificial Sequence
  derived and/or modified sequence opt3 from VP1__Norovirus_and/or_Norovirus-like__AB810014
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuuccgagguauccuuuauggggugcugacacaggauaauguuucagaaggaaccggcgaggccaagaacgcuaaaggcguguacaucagcacuacaagugggaaguuuacccccaagauuggaucuauagguuugcauuccaucacggaaaauguccacccuaaccagcaaagcagauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuaggucgcgggucccuugcgugcagggcuugcguggucaggacgcuuucauugauugucuccugccccaggaaugggucaaucacuuuuaccaagaggccgcaccaucucaggccgacguggcuuuaauccgcuauguuaacccugauacagggagaacucuguucgaagccaaacuacacagguccggcuuuauaaccgugucacauacaggagcauacccccucguagucccaccgaacggccacuuccgguuugacaguugggugaaucaguucuauagccuggcgccuauggggaccggaaacggucgauga

SEQ ID NO: 20339 - RNA, 1617 nt, Artificial Sequence
  derived and/or modified sequence opt3 from VP1__Norovirus_and/or_Norovirus-like__AB809985
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcggggucaggacgcuuucauugauugucuccugccccaggaaugggucaaucacuuuuaccaagaggccgcaccaucccaggccgacguggcuuuaauccguuauguuaacccugauacagggcgcacucuguucgaagccaaacuacacagaucaggcuuuauaaccgugagucauacaggagcauacccccucguagucccaccgaacggccacuucagguuugacagcugggugaaucaguucuauucccuggcgccuauggggaccggaaacggucgguga

SEQ ID NO: 20340 - RNA, 1617 nt, Artificial Sequence
  derived and/or modified sequence opt3 from VP1__Norovirus_and/or_Norovirus-like__AB810003
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaaccgaggggauaauugggaccagaaccuguuacagcugaccuacccgagcggagcaucuuacgaucccacggacgaggucccugcuccacucggcacucaagacuucuccgguauccuuuauggggugcugacacaggauaauguuucagaaggaaccggcgaggccaagaacgcuaaaggcguguacaucagcacuacaagugggaaguuuacccccaagauuggaucuauagguuugcauuccaucacggaaaauguccacccuaaccagcaaagcagauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuaggucgcgggucccuugcgugcagggcuugcguggucaggacgcuuucauugauugucuccugccccaggaaugggucaaucacuuuuaccaagaggccgcaccaucucaggccgacguggcuuuaauccgcuauguuaacccugauacagggagaacucuguucgaagccaaacuacacagguccggcuuuauaaccgugucacauacaggagcauacccccucguagucccaccgaacggccacuuccgguuugacaguugguucaaucaguuuuauagccuggcgccuauggggaccggaaacggucgauga

SEQ ID NO: 20341 - RNA, 1617 nt, Artificial Sequence
  derived and/or modified sequence opt3 from VP1__Norovirus_and/or_Norovirus-like__AB809975
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugucuuacccguccggagcaucauacgaucccaccgacgaggucccugcuccacucggcacgcaagacuucagcgguauccuuuauggggugcugacucaggauaauguuagugaacgaacaggagaggccaagaacgcuaaaggcaucuacauuucuaccacuuccggcaaguuuacacccaagauagggagcaucggauugcauucgauuaccgaaaaugugcacccuaaccagcaaucuagauucacgccagucgguguggcccagaaugagaacacccccuuccagcaguggguacuaccgcauuaugcaggcgcccuggcucucaauacaaaccuggcgccugcaguugccccaacuuuucccggggagcaacuucuguucuuuaggucccgggugccuugcguccagggauugcagggccaggacgcuuucaucgauugucuccugccccaagaaugggugaaucacuuuuaccaggaggccgcaccaucacaggccgacgucgcuuuaauacguuaugugaacccugauaccggucgcacacuguucgaagccaaacuacacagaaguggguuuauuacuguuagccauaccggcgcauacccccucgugguaccaccgaacggacacuucagguuugacuccugggucaaucaguucuauucucuggcgccuaugggcacagggaacggacgguga

SEQ ID NO: 20342 - RNA, 1617 nt, Artificial Sequence
  derived and/or modified sequence opt3 from VP1__Norovirus_and/or_Norovirus-like__JX401280
augaagauggccagcuccgacgcuaaccccucugauggcucaagugcaaaucuggugccugaggucaacaaugaaguuauggcccucgagccagugguaggggcggcuaucgccgcaccgguggccggacagcaaaacaucauagaccccuggaucagaaauaacuucguccaggcuccugguggcgaauuuaccgugagcccaaggaaugcacccggggagauucuuugguccgccccucugucuccagauuugaaccccuacuuaucgcaccugucacggauguauaauggauacgcuggcgguuucgaaguucaggugauccuagccgggaacgcguuuacagcaggaaaaauugucuucgccgcugugccuccaaauuuuccgacugagggccucagccccagucagguaacgauguucccucauaucauaguugacgugcgccaacuggagccaguccuuaucccccugccugaugugcgaaacaauuuuuaucacuacaaccaggccaaugacuccaccuugaagcucauugcaaugcuguauacaccacugcgugcuaacaacgccggcgaugacguguucacugucucuugcagaguucucaccaggcccagcccggauuuugacuucaucuuuuuagugccucccacaguagaaucccggaccaaaccauucacugugccuguccugacaguggaggaaaugaccaauucacgcuuucccauuccacuugagagauuguucacggggcccaguacugcguucguugugcagccucagaacggaagguguaccacagaugguguccugcuaggcacuacccaacucagcgccgugaauaucugcaacuuucgcggggagguaaaucauauagcaggaacacacgacuacaccaugcggcugacgucucagaacuggaauaacuaugauccaacugaagagauuccggcuccccuuggcacaccugacuucguuggucgaauccagggggugcugacccagacuacaagauccgacggaucaaccaggagccauaaggccacggucaguaccggcucugugcacuuuacaccaaaauugggcuccguccaauucacuaccgauacaacuaaugaccucaacgcugggcagaauaccaaguuuacacccgugggaguugaacagaccagcggugaucaccaaucggagccucagcaguggacucugccaaacuacucuggcacgcccaaucauaacgugcacuuagccccggcaguagccccuacauucccaggggaacagcugcucuuuuuccgguccacccuucccggauguggcgguuacccuaauaugaaccuggacugcuugcuaccccaagaguggguccugcauuuuuaucaggaggcugcgccagcacagucagauguggcccuccugcguuucguuaacccugacacugggcgcgugcuuuuugaauguaagcugcacagaaguggcuucauuaccgucgcucacagcggaucccaugauuuggugauucccccaaauggcuacuuuagguucgacucuuggguaaaccaguucuauacacucgccccgauggggaauggaagcggucggcgacgcguguga

SEQ ID NO: 20343 - RNA, 1617 nt, Artificial Sequence
  derived and/or modified sequence opt3 from VP1__Norovirus_and/or_Norovirus-like__KC962462
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagucucucucgcccucacagguaacgauguucccucauaucauaguugacgugcgccaacuggagccaguccuuaucccccugccugaugugcgaaacaauuuuuaucacuacaaccagagcaaugacccaaccauuaaguugaucgcuaugcucuauacaccccugcgugccaacaacgcgggcgaugacguguucacugucaguugcagaguucugaccaggccguccccugauuuugacuucauuuuucucgugcccccaacaguagaaucucggaccaaaccuuucagcgugcccaucuuaacugucgaggaaaugacaaauucccgcuuuccaauaccccuggagaaacuuuucaccgggccuucaagugccuucgugguucagccacagaacggaagauguacgauugaugguguguugcugggcacuacccaacuaagcccggucaauaucugcacauuuaggggagacgugacucauauugcagggacccacaacuacacaaugaaucucgcuacccagaacuggaacucuuaugaucccacggaggaaaucccugccccacugggcacucccgacuucguagguaagauccaggggguucuuacacagaccacuaagacagacggauccacccggggccauaaggcuacgguguguauuggcucagccgauuuugcaccuaaacuggggcgcguccaauucgagaccgacacaaauaaugauuuggaaacuaaccagaauaccaaguuuacaccagugggagucauacagaacggugagacugcccaccgaaaugaaccccaacagugggugcucccgagcuacaguggcagaaacaccccuaauguucaccuggcuccagcgguggcacccacauucccuggggagcaguuacuguuuuucaggucuaccaugcccggaugcuccggcuacccaaacauggaccucgauugucuucugccucaggaguggguacaauauuuuuaccaggaagccgcucccgcccagagcgacgucgcauugcuacgguucgugaacccagauacuggucguguucuguuugagugcaaacuccauaagucgggguaugugacggucgcccacacaggcucucaugaccuggugaucccgccuaauggauacuuccgcuuugauuccuggguaaaccaguucuauacccuugcucccaugggcaaugggacuggaagaaggcgguga

SEQ ID NO: 20344 - RNA, 1617 nt, Artificial Sequence
  derived and/or modified sequence opt3 from VP1__Norovirus_and/or_Norovirus-like__KX353974
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucacugugccuaucuuaacagucgaggaaaugaccaauagccgcuuucccauaccacuggagaaacuuuucacgggacccuccucagccuucgugguucagccucagaacgguagauguacuaccgauggcguguugcuggggacaacucaacuaaguccagucaauauuugcaccuuuaggggagacgugacacauaucgcaggcagccggaacuacaccaugaaucucgcuucucugaacuggaauaacuaugauccgacggaggaaauucccgccccucuugguacuccagacuucguagggaagauccagggaguucugacacagaccacuaagggcgacggcuccacacgcgggcacaaggcuaccguguacacgggaucagccgauuuuacccccaaauuggguagcguccaguucggcacagacacugagaaugauuuugaaauccaucaaaacacccgauucacaccugugggggucauucaggacggaaguacuacccacagaaaugagccacagcaaugggugcuccccucuuacuccggcaggagcguucacaacgugcaucuggcaccggccguagcuccuaauuuuccaggugaacaguuacuguucuuucggucgacaaugcccggguguucuggcuauccuaacauggaucucgacugccuucugccccaggaguggguccagcacuucuaccaagaggcggcaccagcccaguccgauguggcuuugcuacguuuuguuaauccugacaccggacgcgugcuguucgaauguaagcuccauaaaucaggcuaugucacuguggcccacacggggcagcacgaucugguaauacccccaaacggauacuuuagauucgacaguugggugaaccaguucuauacacuugcaccgauggguaauggcaccgggaggcggcgauga

SEQ ID NO: 20345 - RNA, 1617 nt, Artificial Sequence
  derived and/or modified sequence opt3 from VP1__Norovirus_and/or_Norovirus-like__KF060122
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccgucuuaacuguggaggaaaugacaaauagccgcuuuccaguuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccacaacuacaccaugaaucucgcaucucagaacuggaacuccuaugaucccacggaggaaauuccugcuccacuggguacucccgacuucguggggaagauccagggaguccuuacacagaccacucgggccaauggcucaacacgcggccauaaggcuaccguguacacggggagcgccgacuuugcaccuaagcugggacgaguccaauucgccaccgauacaaauaacgacuuugaugcuaaucagaacacuaaauucaccccaguggguguuauucaggacggcgauacagcgcacagaaaugagccccaacaguggguguugccgaguuacucugggaggaacucccacaauguacaucucgccccugcagucgcuccaacuuuucccggagaacagcuguuauucuuucggagcaccaugccuggcuguucggguuaucccaacauggaccuggauugccuccuuccacaggagugggugcaauacuucuaucaggaagccgccccugcacagucugacguugcucuguugcguuuugugaaccccgauacagggcgcguccuauucgaguguaagcugcacaaauccggcuacgugaccguagcccauacuggacagcacgaccucgugaucccaccgaauggcuauuuuagauucgauucauggguuaaccaauucuacacgcuggcaccuauggggaauggaacagguaggcggcgauga

SEQ ID NO: 20346 - RNA, 1617 nt, Artificial Sequence
  derived and/or modified sequence opt3 from VP1__Norovirus_and/or_Norovirus-like__KR904234
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauagugccggggaugacguguucaccgucuccugcagaguucugacaaggccgucuccugauuuugacuucauuuuucucgugcccccaaccguagaaagccggacuaaaccuuucuccgugcccaucuuaacagucgaggaaaugaccaacucacgcuuuccaauaccccuggagaaacuuuucacgggaccuaguagcgcguucgugguucagccacagaacgguagauguacuaccgauggcguguugcuggggacaacucaacuaucuccggucaauauuugcuccuuuaggggagacgugacccauaucgccggcucacggaacuacacaaugaaucucgcaagccagaacuggaauaguuaugaucccaccgaggaaauuccugcuccacuggguacgcccgacuucguagggaagauccagggaguucuuacucagacaacccgcacugacggcucuacacgaggccacagagccaccguguacacgggguccgcugauuuuagcccuaagcugggaaggguccaauucgccaccgacacagauaacgacuuuguggcaaaucagaacacuaaguucaccccagucggugugauccaggauggcgacacagcccaucggaaugagccccaacaguggguuuugccgucguacucugggcguaacauucacaaugugcaccucgcuccugcgguagcaccaacuuuucccggagaacagcuguuauucuuucgcuccaccaugccuggcuguucagguuaucccaacauggaucuggacugccuccuuccacaggaguggguccaacauuucuaccaggaagccgcuccugcccagagugauguggcacuguugagauuuguuaaucccgacacagggagggugcuauucgaguguaaacugcacaagagcggcuaugucaccguggcccauacuggacagcacgaucucguaauaccaccgaacggcuacuuucgguucgacuccugggugaaucaauucuauacgcuggcuccuauggggaacggaacaggucgacgcagauga

SEQ ID NO: 20347 - RNA, 1617 nt, Artificial Sequence
  derived and/or modified sequence opt3 from VP1__Norovirus_and/or_Norovirus-like__KR131769
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcgauugugguucagccacagaaugguagguguaccacagauggcguguugcuggggacuacccaacuauccgccgucaacaucugcacauuccggggagacgugacccauauugcaggcucacgcaauuauacgaugaaccucgcuagucagaauuggaacaauuacgauccgacugaggaaauccccgccccucuggguacaccagacuucguagggaagauccagggaaugcuuacccagacuacacgaagcgacggcucuaccagaggccacaaagcuacgguucugaccggguccgccgauuuugcacccaaguugggaagggugcaauucgccacagacacugauaacgacuuugagucaggucagaauaccaaguucacaccugucggcgugauucaggaugggagcacuacccaucggaacgaaccacaacaguggguccuccccaauuacaguggacguacaggccacaacgugcaccuggcuccggcgguugcaccuaccuauccaggugagcaguuacuguuuuuccgcucuacuaugcccggguguuccggcuacccuaauauggaccucgauugccuucugccccaggaaugggugcaacauuuuuaucaggaggccgcuccagcccagagcgacguagcauugcuaagauucgucaacccugauacgggaagggugcuguuugaguguaaacuccacaagucgggcuacguuacaguggcccauaccgggcagcacgaccuggucauacccccaaacggauauuuccgguuugauucuugggugaaucaauucuacacucuugcuccgauggguaacggcaccgggcgacgcagauga

SEQ ID NO: 20348 - RNA, 1617 nt, Artificial Sequence
  derived and/or modified sequence opt3 from VP1__Norovirus_and/or_Norovirus-like__KR131764
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaucaagucgcaauuauacgaugaaccucgcuagccagaauuggaacaauuacgauccgacugaggaaauucccgccccucugggcacaccagacuuuguagguaagauccaggggaugcuuacccagacuacaaaaucugacggauccacccgaggccacaaggcuacgguucugaccggcucagccgauuucgcacccaaguuggggagagugcaauuugccacagacacugauaacgacuucgagagcggacagaauaccaaauuuacaccugucggugugauccaggauggcaguacuacccauaggaacgaaccacaacaguggguccuccccaauuacucugggcggacaggacacaacgugcaccuggcuccggcgguugcaccuaccuauccaggcgagcaguuacuguucuuucguuccacuaugcccgguuguagcggguacccuaauauggaccucgauugccuucugccccaggaaugggugcaacauuucuaucaggaggccgcuccagcccagucggacguagcauugcuacgcuuugucaacccugauacgggcagagugcuguucgaguguaagcuccacaaaucuggauacguuacaguggcccauaccggccagcacgaccuggucauucccccaaacggguauuuuagguucgauuccugggugaaucaauuuuacacucuugcuccgaugggaaacgguaccggccggcgacgcuga

SEQ ID NO: 20349 - RNA, 1617 nt, Artificial Sequence
  derived and/or modified sequence opt3 from VP1__Norovirus_and/or_Norovirus-like__GU390901
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucacgggcagucggaacuacacuaugaaucucgccacacagaacuggaauagcuaugaucccaccgaggaaauuccugcaccacuggguacucccgacuucguagggaagauccagggaguucuuacacagaccacgcgcgcugacggcucuacccgaggccacaaggccacaguguacacuggguccgcugauuuuucaccuaagcugggaagaguccaauucgccaccgacacagauaacgacuuugaugcaaaucagaacacuaaauucaccccagugggugucauccaggacggcgauacagcccauaggaaugagccccaacaguggguguugccgagcuacagugggcggaacucucacaauguucaccucgcuccugcgguggcaccaaccuuucccggagaacagcuguuauucuuucguuccacuaugccuggcuguagcgguuaucccaacauggaccuggauugccuccuuccacaggaguggguacaauacuucuaucaggaagccgcuccugcccagucggacgucgcacuguugcgcuuugugaaucccgauacggggagaguucuauucgaguguaagcugcauaaaucuggcuacgugacagucgcccacaccggacagcaugaccucgugauuccaccgaacggcuauuuuagguucgacuccuggguaaaccaauucuacacucuggcuccuauggggaauggaaccggucggcgacgcuga

SEQ ID NO: 20350 - RNA, 1617 nt, Artificial Sequence
  derived and/or modified sequence opt3 from VP1__Norovirus_and/or_Norovirus-like__EU078408
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacucgcccuuucacagugcccaucuuaaccgucgaggaaaugacuaauucuagauuuccaauaccccuggagaaacuuuucacgggaccuagcggugcguucgugguucagccacagaacgggagguguaccacagauggcguguugcugggaacuacccaacuauccccggucaauauuugcacauuucggggcgacgugacccauaucgccgguacgcacgauuacacuaugaaccucgcaucacagaauuggaacaauuaugaccccacagaggaaauuccugcuccacuggggacccccgacuucguaggaaagauccagggcguucuuagucagacuacacgcggcgaugggagcacccgaggacauaaagccacggugucuaccgguuccguccacuuuacaccuaagcugggcucagugcaauucacuaccgacacaaacaaugauuuggagacugggcagaacaccaaguuuacaccagucggagugguucaggacggcaauagcacccaccaaaacgaaccccagcagugggugcucccgaauuacagugguagaacugggcauaacguacaccuggcuccugccgucgcaccaacguuccccggcgagcaguuacuguuuuucaggucuacaaugccuggauguuccggcuaccccaauaugaaccucgauugccuucugccacaagaaugggugcagcauuuuuaucaggaggccgcuccugcgcagagcgacguugcauugcuacgguucgugaaccccgauaccgggcguguccuguuugaguguaaacuccacaagucgggauacgugacuguagcccacaccggucaacaugaccuggugaucccaccgaauggcuauuuccgcuuugauucuuggguuaaccaguucuacacacuugcuccuauggggaauggagccggcagaaggcgguga

SEQ ID NO: 20351 - RNA, 1617 nt, Artificial Sequence
  derived and/or modified sequence opt3 from VP1__Norovirus_and/or_Norovirus-like__AB933676
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaguauuugcaccuuuaggggagacgugacacauaucgcaggcagccgggauuacaccaugaaccucgcuucucugaauuggaacaauuaugacccgacggaggaaauucccgccccucuugguacuccagacuucguagggaagauccagggaguucugacacagaccacuaagggcgauggcuccacacgcgggcacaaggcuaccguguacacgggaucagcccccuuuaccccuaaauuggguagcguccaguucaguacagacacugagaacgauuuugaaacccaucaaaauacaaaguucacuccagugggcgucauccaggacgggucuaccgcacaccgaaacgagccccagcaaugggugcucccguccuacagcggaagaaauguucagaacgugcaccuggccccugcuguagcgccaacauuucccggcgaacaguuacuguucuuuaggucgaccaugccugguuguucuggguaucccaauauggaucucgacugccuucugccacaggaguggguccaacauuucuaccaggaggcagccccugcucaguccgauguggccuugcuacgguuuguuaaccccgacacuggccgugugcuguucgaauguaaacuccacaagucaggauaugucacgguggcacauacaggccagcacgaucugguaauuccaccgaauggguacuuucgcuucgacaguugggugaaccaauucuauacccuugccccuaugggaaacgguacuggcagaaggcgguga

SEQ ID NO: 20352 - RNA, 1617 nt, Artificial Sequence
  derived and/or modified sequence opt3 from VP1__Norovirus_and/or_Norovirus-like__KX354082
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuaucguggacguccgccaacuggagccagugcuuauaccccugccugaugugcgaaacaauuuuuaucacuacaaccagucaaaugacagcaccaucaaguugauugcuaugcucuauacaccacugcgugccaacaacgcgggggaugacgucuucacuguuaguugcagagugcugaccaggcccuccccggauuuugacuucaucuuucucguaccucccacaguggaaucucggaccaaaccauucacugucccuauuuuaacaguggaggaaaugaccaauagccgcuuucccaucccacuggagaaacuuuucacgggacccuccucagccuucguugugcagccucagaacgguagauguacuaccgauggcgucuugcuggggacaacucaacuaaguccagugaauauaugcaccuuuaggggagacguaacacauauugcaggcagccggaacuacaccaugaaucucgcuucucugaacuggaauaacuaugauccgacggaggaaauccccgccccucuugguacuccagacuucguugggaagauucagggagugcugacacagaccacuaagcgcgacggcuccacacgaggccacaaggcuaccgucuacacggggucagccgauuuuacccccaaauugggaagcgugcaguucgguacagacacugagaaugauuuugaaacccaucaaaacacaagauucacuccugucggcgugauccaggacgggaguaccacacacaggaaugagccacagcaauggguucuccccucuuacuccggacggaacgugcacaauguacaucuggcaccggccgucgcuccuaacuuuccaggcgaacaguuacuguucuuucguagcaccaugcccgguuguucgggguauccuaauauggaucucgacugccuucugccccaggagugggugcagcacuucuaccaagaggcggcaccagcccagucugauguugcuuugcuacgcuuugugaacccugacacuggcagaguccuguucgaauguaagcuccauaaauccggauaugugacgguagcccacacaggccagcacgaucuggugauucccccaaacggguacuuuagguucgacucauggguuaaucaguucuauacccuugcaccgaugggaaacgguacuggccggcgacgcuga

SEQ ID NO: 20353 - RNA, 1617 nt, Artificial Sequence
  derived and/or modified sequence opt3 from VP1__Norovirus_and/or_Norovirus-like__KJ407076
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugagcaauucccgcuuucccauaccacuggagaaacuuuacacgggacccucaagugcguucgugguucagccucagaacgguagauguacuaccgauggcguguugcuggggacaacucaacuaagcgccgucaauauuugcaccuucaggggagacgugacacauaucgcaggcucucacgauuauaccaugaaccucgcuucccagaauuggaacaauuacgacccaacggaggaaauuccggcuccccuggguacuccugacuuuguagggaagauccagggaaugcuuacacagaccacucgggaggauggcucaacacgcgcccauaaggccaccguuagcacgggcagugugcacuucaccccaaagcuggggucuguccaauacacaacugacaccaacaaugauuuucagacaggacagaacacuaaauucacccccgugggugucauccaagacggcaauaaccaccagaaugaaccucagcaguggguguugccaaacuauuccgggcgaacaggacauaauguucaccucgcacccgccguggcuccgaccuuuccuggcgagcaacuguuauucuuuagaagcacuaugccagguuguucgggguaccccaacaugaaccuggauugccuccuuccucaggaauggguacagcauuucuaucaggaggcggcacccgcccaaucugacgucgcucuguugagguuugugaauccagauacgggccggguucuauucgaguguaagcugcacaaauccggauacgugacagucgcccacaccggcccucaugaccucgugauucccccaaacggguauuuucguuucgauucauggguaaaucaguuuuacacucuggcaccgaugggaaacggugccggccgcagaaggguguga

SEQ ID NO: 20354 - RNA, 1617 nt, Artificial Sequence
  derived and/or modified sequence opt3 from VP1__Norovirus_and/or_Norovirus-like__JX459636
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccgggacuacaccaugaaccucgcuucucugaauuggaacaauuaugauccgacggaagagauucccgccccucuugguacuccagacuucguagggaagauccagggaguucugacacagaccacuaagggcgacggcuccacacgcgggcacaaggcuaccguguacacgggaucagcccccuuuaccccuaaauuggguagcguccaguucaguacagauacugaaaacgacuuugagacccaucaaaauacaaaguucacuccagugggcgucauccaggaugggucuaccacacaccgaaacgaaccccagcaaugggugcucccguccuacagcggaagaaauguucagaacgugcaccuggccccugcaguagcuccaaccuuucccggcgagcaguuacuguucuuuaggucgacuaugccugguuguucuggguaucccaauauggaccucgauugccuucugccacaggaguggguccaacauuucuaccaggaagcggccccugcacaguccgacguggcuuugcuacgguuuguuaaccccgauacgggccgugugcuguucgaguguaaacuccacaagucaggauaugucacaguggcccauaccggccagcacgaccugguaauuccaccgaauggguacuuucgcuucgauaguugggugaaccaauucuauacucuugcaccuaugggaaacgguaccggcagaaggcgguga

SEQ ID NO: 20355 - RNA, 1617 nt, Artificial Sequence
  derived and/or modified sequence opt3 from VP1__Norovirus_and/or_Norovirus-like__JX445161
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucacgggcagucggaacuacacuaugaaucucgccacacagaacuggaauagcuaugaucccaccgaggaaauuccugcaccacuggguacucccgacuucguagggaagauccagggaguucuuacacagaccacgcgcgcugacggcucuacccgaggccacaaggccacaguguacacuggguccgcugauuuugccccuaagcugggaagaguccaauucgcaaccgacacagauaacgacuuugaugccaaucagaacacuaaauucaccccagugggugucauccaggacggcgauacagcucauaggaaugagccccaacaguggguguugccgucauacagcgggcggaacagucacaauguucaccucgcgccugcaguggccccaaccuuucccggagaacagcuguuauucuuucguucuacuaugccuggcuguuccgguuaucccaacauggaccuggauugccuccuuccacaggaguggguacaauacuucuaucaggaagcugccccugcacagagcgacgucgcccuguugcgcuuugugaaucccgauacggggagaguucuauucgaguguaagcugcauaaaucgggcuacgugacagucgcucacaccggacagcaugaccucgugauuccaccgaacggcuauuuuagguucgacucuuggguaaaccaauucuacacucuggccccuauggggaauggaaccggucggcgacgcuga

SEQ ID NO: 20356 - RNA, 1617 nt, Artificial Sequence
  derived and/or modified sequence opt3 from VP1__Norovirus_and/or_Norovirus-like__EU876888
augaagauggccagcuccgacgcuucucccucagauggcagugcagccaaccuggugccugaggucaauaacgaaguuauggcgcucgagccagugguaggggcugccaucgcagccccgguggcuggacagcaaaauauuauagaccccuggaucagaaacaauuucguccaggcaccugguggcgaauuuaccgugagcccaaggaacgcccccggggagauucuuugguccgcuccucugggaccagauuugaaucccuacuuaucucaccugucgcggauguauaacggcuacgccgguggguucgaaguucaggugauccuagcgggaaaugcauuuacagccggcaaagucauuuucgcugccgugccuccaaacuuuccgacugagggccucucacccagccagguaacgauguucccucauaucauaguugacgugcgccaacuggagccaguccuuaucccccugccugaugugcgaaauaacuuuuaucacuacaaucagaccaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucacagugcccaucuuaaccgucgaggaaaugacgaacagccgcuuuccaauaccccuggagagacuuuacacuggaccuuccucagcguucgugguucagccacagaaugguagguguaccacagauggcguguugcuggggacuacccaacuaagugccgucaacauuugcacauuccggggagacgugacccauaucgcaggcagccgcaauuauacgaugaaccucgcuucucagaauuggaacaauuacgauccgacugaggaaauucccgccccucuggguacaccagacuuuguagggaagauccagggaaugcuuacccagacuacacgaggcgacggcuccaccagagggcacaaagcuacgguuuacaccggaucagccgauuucgcacccaagcuggguagggugcaauuugccacagacacugauaacgacuucgagagcaaucagaacaccaaguuuacaccugucggcgugauccaggaugggaauacuacccaucggaacgaaccacaacagugggucuugcccggauauaguggccgugacggucacaaugugcaccucgcuccggcgguugcaccuacauacccaggggagcagcuguuauucuuucgcucuaccaugcccggcuguuccggauauccuaacauggaucuggacugccuccuuccccaggaaugggugcaacauuucuaccaggaggccgcuccagcccagagcgagguagcacuguugagauuugucaauccugauacuggcagggugcuauucgaauguaaacugcacaagucgggguauguuacgguggcccauacaggacagcacgaccucgucauucccccaaacgguuacuuucgguucgauucuugggugaaccaauuuuauacccuggcuccgaugggcaauggggccggacgacgcagauga

SEQ ID NO: 20357 - RNA, 1617 nt, Artificial Sequence
  derived and/or modified sequence opt3 from VP1__Norovirus_and/or_Norovirus-like__EU839584
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaaccaagcgggacggcagcacgcgcggccacaaggccaccgugucuacaggguccguccauuuuacuccuaaacugggaucagugcaguucagcaccgauacaaguaaugacuuugagaucggucagaacacucgauucaccccagucggcgugguucaagaugggucuacaacccaccagaaugaaccccagcaguggguguugccgaacuacuccggaagagacggccacaauguacaucucgcuccugccgucgcaccaacuuuucccggugagcaacuguuauucuuuaggagcacgaugccuggguguucgggcuaccccaacaugaaucuggauugccuccuuccacaggaaugggugcagcacuucuaucaggagucugccccugcucaauccgacguugcgcuguugcgguuugugaaccccgauacaggacgugcacuauucgaguguaagcugcauaaaucaggcuacgucaccguggcccacacugggcagcacgaccucguaauuccaccgaacggauauuuucgcuucgauaguugggugaaucaguucuacacccuggcuccuauggguaacggcgccgggagaaggcgguga

SEQ ID NO: 20358 - RNA, 1617 nt, Artificial Sequence
  derived and/or modified sequence opt3 from VP1__Norovirus_and/or_Norovirus-like__KX354090
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucacugugccuaucuuaacagucgaggaaaugaccaauagccgcuuucccauaccacuggagaaacuuuucacgggacccuccucagccuucgugguucagccucagaacgguagauguacuaccgauggcguguugcuggggacaacucaacuaaguccagucaauauuugcaccuuuaggggagacgugacacauaucgcaggcagccggaacuacaccaugaaucucgcuucucugaacuggaauaacuaugauccgacggaggaaauucccgccccucuugguacuccagacuucguagggaagauccagggaguucugacacagaccacuaagggcgacggcuccacacgcgggcacaaggcuaccguguacacgggaucagccgauuuuacccccaaauuggguagcguccaguucggcacagacacugagaaugauuuugaaacccaucaaaacacacgauucacuccugugggggucauccaggacggaaguaccacacacagaaaugagccacagcaaugggugcuccccucuuacuccggcaggaacguucacaaugugcaucuggcaccggccguagcuccuaacuuuccaggugaacaguuacuguucuuucggagcaccaugcccggguguucgggcuauccuaauauggaucucgacugccuucugccccaggaguggguccagcacuucuaccaagaggcggcaccagcccagucugauguggcuuugcuacguuuuguuaacccugacacuggacgcgugcuguucgaauguaagcuccauaaauccggcuaugucacgguggcccacacagggcagcacgaucugguaauucccccaaacggauacuuuagauucgacucaugggugaaucaguucuauacccuugcaccgauggguaacggcacugggaggcggcgauga

SEQ ID NO: 20359 - RNA, 1617 nt, Artificial Sequence
  derived and/or modified sequence opt3 from VP1__Norovirus_and/or_Norovirus-like__KF060124
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccgucuuaacuguggaggaaaugacaaauagccgcuuuccaguuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccacaacuacaccaugaaucucgcaucucagaacuggaacuccuaugaucccacggaggaaauuccugcuccacuggguacucccgacuucguggggaagauccagggaguccuuacacagaccacucgggccgacggcucaacacgcggccauaaggcuaccguguacacggggagcgccgauuuugcaccuaagcugggacgaguccaauucgccaccgacacaaauaaugauuuugacgcuaaccagaauacuaaauucaccccaguggguguuauucaggauggcgacacagcgcacagaaacgagccccaacaguggguguugccgaguuacucugggaggaacucccacaauguacaucucgccccugcagucgcuccaacuuuucccggagaacagcuguuauucuuucggagcaccaugccuggcuguucggguuaucccaauauggaucuggacugccuccuuccacaggagugggugcaauacuucuaucaggaagccgccccugcacagucugauguugcucuguugcguuuugugaaccccgacacagggcgcguccuauucgaguguaagcugcacaaauccggcuacgugaccguagcccauacuggacagcacgaucucgugaucccaccgaacggcuauuuuagauucgacucauggguuaaucaauucuacacgcuggcaccuauggggaacggaacagguaggcggcgauga

SEQ ID NO: 20360 - RNA, 1617 nt, Artificial Sequence
  derived and/or modified sequence opt3 from VP1__Norovirus_and/or_Norovirus-like__JX439826
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccaucuuaacugucgaggaaaugacaaauagccgcuuuccaauaccccuggagaaacuuuucaccggaccuuccucagccuucgugguucagccacagaacgguagauguacgacugauggcguguugcuggggaccacacaacuaaguccggucaauauuugcacuuuuaggggagacgugacccauaucacaggcagccggaacuacaccaugaaucucgcaacgcagaacuggaacucuuaugaucccacugaggaaauuccugcuccacuggguacacccgacuucguagggaagauccagggaguucuuacccagacuacacgcgccgacggcuccacccgaggccacaaggcuacgguguacaccgggucagccgauuuugcaccuaagcugggaagaguccaauucgccacagacacugauaaugacuuugaugcuaaucagaacaccaaauucacaccagugggugucauccaggacggcgauacugcgcauaggaaugagccccaacaguggguguugccgagcuacagugggcggaacucucacaauguucaccucgccccugcaguggcuccaaccuuucccggagaacagcuguuauucuuucguuccacaaugccuggcuguagcgguuaucccaacauggaccuggauugccuccuuccacaggaguggguacaauacuucuaucaggaagccgccccugcacagucggacgucgcucuguugcgcuuugugaaucccgauaccgggagaguucuauucgaguguaagcugcauaaaucuggcuacgugacugucgcccacacgggacagcaugaccucgugauuccaccgaacggcuauuuuagguucgacuccuggguaaaccaauucuacacacuggcaccuauggggaauggaaccggucggcgacgcuga

SEQ ID NO: 20361 - RNA, 1617 nt, Artificial Sequence
  derived and/or modified sequence opt3 from VP1__Norovirus_and/or_Norovirus-like__JX439815
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccaucuuaacagucgaggaaaugaccaacucucgcuuuccaauaccccuggagaaacuuuucacgggaccuagcuccgcguucgugguucagccacagaaugguagauguacuaccgauggcguguugcuggggacaacucaacuaucaccggucaacauuugcaccuuuaggggagacgugacacauaucaccggcagucggaauuacacgaugaaccucgccacucagaauuggaacagcuaugaucccacagaggaaauuccugcaccacuggguacccccgacuucguagggaagauccagggaguucuuacucagacaacccgcgcugacggcucuacgcgaggccacaaggccaccguguacacaggguccgcugauuuugccccuaagcugggaagaguccaauucgcaacugacaccgauaaugacuuugaugccaaccagaauacaaaauucacuccagugggugucauccaggacggcgauaccgcucauaggaacgagccccaacaguggguguugccgucauacagcgggcggaauagucacaacguucaccucgcgccugcaguggccccaacauuucccggagaacagcuguuauucuuucguucuaccaugccuggcuguuccgguuaucccaauauggaccuggauugccuccuuccacaggaguggguacaauacuucuaucaggaagcugccccugcacagagcgacgucgcccuguugcgcuuugugaaccccgauacugggagaguucuauucgaguguaagcugcauaaaucgggcuacgugacggucgcucacacaggacagcaugaccucgugauuccaccgaacggcuauuuuagguucgacucuuggguaaaucaauucuacacccuggccccuauggggaacggaacuggucggcgacgcuga

SEQ ID NO: 20362 - RNA, 1617 nt, Artificial Sequence
  derived and/or modified sequence opt3 from VP1__Norovirus_and/or_Norovirus-like__KC576912
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcagaugauucuagcaggaaacgccuuuacagcuggcaaaaucauuuucgccgcagucccuccaaauuuuccgacugagggccucucucccucacaggugacgauguucccucauaucauaguagacguucgccaacuggagccagugcuuaucccccugccugauguccgaaacaauuuuuaucacuacaaccagucgaaugacccaaccauuaaguugaucgcuaugcucuauacaccccugcgugccaacaacgcgggggaugacguguucacugugagcugcagaguccugaccaggccgaguccugauuuugacuucauuuuucucguucccccaacaguggaaucccggaccaaaccuuucacuguacccguguuaacagucgaggaaaugaccaauucucgcuuuccaaucccccuggagaaacuuuucacgggaccuagcuccgccuucgugguucagccacagaacgguagauguacuaccgauggcguguugcuggggacaacucaacuaucaccggucaauauaugcaccuuuaggggagacgugacacauauugcaggcagucggaacuacaccaugaaucucgcuagccugaacuggaauaacuaugaucccacggaggaaaucccugccccacuugguacucccgacuucguagggaagauucagggaguucugacacagaccacuaagggcgacggcucuacacgcgggcacaaggcuaccguguacacgggauccgccgauuuuaccccuaaauuggguucaguccaguucggcacagacacugauaaugacuuugagacccaucaaaacacacgauucacuccagugggggucauccaggauggagcaaccacacacagaaaugaaccccagcaaugggugcucccgagcuacaguggcaggaacguucacaaugugcaucuggccccugcuguagcgccaaacuuucccggugagcaguuacuguucuuucggucuaccaugccuggguguuccggcuaucccaauauggaccucgauugccuucugccacaggaauggguccagcacuucuaccaagaggcagccccugcucagagcgacguggccuugcuacguuuuguuaaccccgauacuggacgcgugcuguucgaguguaagcuccauaaaucgggcuaugucacgguggcacacacagggcagcacgaccugguaaucccaccgaacggauacuuuagauucgauucuugggugaaucaguucuauacccuugccccuauggguaacggcacugggaggcggcgauga

SEQ ID NO: 20363 - RNA, 1617 nt, Artificial Sequence
  derived and/or modified sequence opt3 from VP1__Norovirus_and/or_Norovirus-like__GQ845368
augaagauggccagcuccgacgcuucucccucagauggcagugcagccaaccuggugccugaggucaauaacgaaguuauggcgcucgagccagugguaggggcugccaucgcagccccgguggcuggacagcaaaauauuauagaccccuggaucagaaacaauuucguccaggcaccugguggcgaauuuaccgugagcccaaggaacgcccccggggagauucuuugguccgcuccucugggaccagauuugaaucccuacuuaucucaccugucgcggauguauaacggcuacgccgguggguucgaaguucaggugauccuagcgggaaaugcauuuacagccggcaaagucauuuucgcugccgugccuccaaacuuuccgacugagggccucucacccagccagguaacgauguucccucauaucauaguugacgugcgccaacuggagccaguccuuaucccccugccugaugugcgaaauaacuuuuaucacuacaaucagaccaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucacagugcccaucuuaaccgucgaggaaaugacgaacagccgcuuuccaauaccccuggagagacuuuacacuggaccuuccucagcguucgugguucagccacagaaugguagguguaccacagauggcguguugcuggggacuacccaacuaagugccgucaacauuugcacauuccggggagacgugacccauaucacgggcagccgcaauuauacuaugaaccucgcaucucagaauuggaacaauuacgauccgacagaggaaauucccgcuccucuggguaccccagacuuuguagggaagauccagggaaugcuuacucagacaacccgaggcgacggcuccacgagagggcacaaagccaccguuuacacaggaucagcugauuucgcccccaagcuggguagggugcaauuugcaacugacaccgauaacgacuucgagagcaaucagaacacaaaguuuacuccugucggcgugauccaggaugggaauaccacacaucaaaacgaaccacagcagugggucuugcccggauauaguggccgggacggucacaaugugcaccucgccccggcuguugcgccuaccuacccaggggagcagcuguuauucuuucguucuacuaugcccggcuguuccggauauccuaacaugaaucuggauugccuccuuccccaagaaugggugcagcauuucuaccaggaggcagccccagcucagagcgagguagcccuguugcgcuuugucaacccugacacgggcagagugcuauucgaauguaaacugcacaagucgggguauguuacaguggcacauaccggacaacacgaucucgucauucccccaaacgguuacuuuagguucgacucuugggugaaucaguuuuauacucuggccccgaugggcaacggggcuggacggcgacgcuga

SEQ ID NO: 20364 - RNA, 1617 nt, Artificial Sequence
  derived and/or modified sequence opt3 from VP1__Norovirus_and/or_Norovirus-like__AB541249
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacgggacuacacgaugaaucucgcuagucugaacuggaauaacuaugauccgacugaagagauucccgccccucuugggacaccagacuucguaggaaagauccaaggcguucugacccagacuacaaagggcgacgggagcacccgcggacacaaggcuacgguguacaccgguucugcccccuuuacaccuaaauugggcuccguccaguucucaacugauaccgaaaaugacuuugaggcacaucagaacacaaaguucacuccagugggggucauccaagauggaagcaccacacaccgaaaugaaccccagcagugggugcucccgaguuacucuggcagaaacguucaaaaugugcaccuggccccugcuguagcgccaaccuuucccggugagcaguuacuguucuuuagguccacuaugccuggguguagcggcuaucccaacauggaccucgauugccuucugccacaggaguggguccagcauuucuaccaagaagcagccccugcucagucggacguggccuugcuacgguuuguuaaucccgauacgggacgugugcuguucgaguguaaacuccacaagucuggcuaugucacaguggcacauaccgggcagcacgaccugguaauuccaccgaacggauacuuucgcuucgauuccugggugaaccaguucuauacucuugccccuauggguaauggcaccgggagaaggcgguga

SEQ ID NO: 20365 - RNA, 1617 nt, Artificial Sequence
  derived and/or modified sequence opt3 from VP1__Norovirus_and/or_Norovirus-like__EU078412
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucaguugaacgacccaacaauuaagcucaucgcaaugcuguauacuccccugcgugcuaauaacgccggggaugacguguucaccgucagcugcagaguucucacaaggccgaguccugauuuugacuucaucuuuuuagugcccccaaccguagaaucccggacuaaaccuuucacagugcccauucugaccgucgaggaaaugacgaacucucgcuuuccaauaccccuugagaaguuguucacuggaccuagcggugcguucgugguucagccacagaauggcagauguaccacagauggggugcugcuaggaacuacccaacucuccccggucaacauuugcacauuuaggggcgacgugacccauaucgccgguacgcacgauuacacuaugaaucuggcaucacagaacuggaauaacuaugaccccacagaggaaauuccugcuccacuugggacccccgacuucguaggaaaaauccagggcguucugacucagacaacccggggcgaugggaguacgcgcggacauaaggccaccgugagcacagguucuguccacuuuacuccuaaguugggcuccgugcaauucaccacagacacuaauaacgaucucgagaccgggcagaauacacgauuuaccccagucggagugguucaggacggcaacucaacucaccaaaaugaaccccagcagugggugcugccgaacuacagcgguagagcugggcauaauguacacuuagccccugcagucgccccaacguuccccggcgagcagcugcucuuuuucaggaguacaaugccuggauguucuggcuaccccaacaugaaucuugauugccuguugccacaagaaugggugcagcauuuuuaucaggaggcugcgccugcacaguccgacguugcccuacugcgguucgugaaccccgauaccgggcguguccucuuugaguguaaacugcacaagagcggauacgugacuguagcucacaccggucaacaugaccuugugaucccaccgaacggcuauuuccgcuuugauucguggguuaaucaguucuacacacuggccccuauggggaacggagcaggcagaaggcgguga

SEQ ID NO: 20366 - RNA, 1617 nt, Artificial Sequence
  derived and/or modified sequence opt3 from VP1__Norovirus_and/or_Norovirus-like__AB445395
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcgauaccgcucauaggaaugagccccaacaguggguguugccgagcuacagugggcggaacaaucacaacguucaccucgcgccugcaguggccccaacauuucccggagaacagcuguuauucuuucguucuaccaugccuggcuguuccgguuaucccaauauggaccuggauugccuccuuccacaggaguggguacaauacuucuaucaggaagcugccccugcacagagcgacgucgcccuguugcgcuuugugaaccccgauacugggagaguucuauucgaguguaagcugcauaaaucgggcuacgugacggucgcucacacaggacagcaugaccucgugauuccaccgaacggcuauuuuagguucgacucuuggguaaaucaauucuacacccuggccccuauggggaacggaacuggucggcgacgcuga

SEQ ID NO: 20367 - RNA, 1617 nt, Artificial Sequence
  derived and/or modified sequence opt3 from VP1__Norovirus_and/or_Norovirus-like__AB933655
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucggcacagacacugagaacgauuuugaaacccaucaaaauacaaaguucacuccugugggggucauccaggacggaagcaccacacaccgaaacgagccacagcaaugggugcuccccaguuacucuggcagaaauguucacaacgugcaucuggcaccggccguagcuccuaauuuuccaggugaacaguuacuguucuuuagguccaccaugcccggguguagcggcuauccuaacauggaucucgacugccuucugccccaggaguggguccagcacuucuaccaagaggcggcaccagcccagucggauguggcuuugcuacgguuuguuaacccugacacuggacgugugcuguucgaauguaaacuccauaagucuggcuaugucacgguggcccacacagggcagcacgaucugguaauucccccaaauggauacuuucgcuucgacuccugggugaaccaguucuauacccuugcaccgauggguaauggcacugggagaaggcgguga

SEQ ID NO: 20368 - RNA, 1617 nt, Artificial Sequence
  derived and/or modified sequence opt3 from VP1__Norovirus_and/or_Norovirus-like__KM245072
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaacucccgcuuuccaauaccccuggagaaacuuuucacgggaccuucaagugcguucgugguucagccacagaaugguagauguacuaccgauggcguguugcuggggacaacucaacuaagcccggucaacauuugcaccuuuaggggagacgugacacauaucaccggcucucggaauuacacgaugaaccucgccacucagaauuggaacuccuaugaucccacagaggaaauuccugcaccacuggguacccccgacuucguagggaagauccagggaguucuuacucagacaacccgcgcugacggcucaacgcgaggccacaaggccaccguguacacagggagcgcugauuuugccccuaagcugggaagaguccaauucgcaacugacaccgauaaugacuuugaugccaaccagaauacaaaauucacuccagugggugucauccaggacggcgauaccgcucauaggaacgagccccaacaguggguguugccgaguuacucugggcguaauucccacaacguucaccucgcgccugcaguggccccaacauuucccggagaacagcuguuauucuuucggagcaccaugccuggcuguucggguuaucccaauauggaccuggauugccuccuuccacaggaguggguacaauacuucuaucaggaagcugccccugcacagucugacgucgcccuguugcgcuuugugaaccccgauacugggagaguucuauucgaguguaagcugcauaaauccggcuacgugacggucgcucacacaggacagcaugaccucgugauuccaccgaauggcuauuuuagguucgacucauggguaaaccaauucuacacccuggccccuauggggaacggaacuggucggcgacgcuga

SEQ ID NO: 20369 - RNA, 1617 nt, Artificial Sequence
  derived and/or modified sequence opt3 from VP1__Norovirus_and/or_Norovirus-like__AB541282
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaugacguguucaccgucagcugcagaguucugacaaggcccaguccggauuuugacuucauuuuucucgugccucccaccguagaaucccggacuaaaccauucacagugccuaucuuaaccgucgaggaaaugacgaacucucgcuuucccauaccacuggagaaacuuuucacuggacccagcggugccuucgugguucagccucagaauggcagauguaccacagaugggguguugcugggaacuacccagcuauccccagucaacauuugcacauuuaggggcgacgugacccauaucgcagguucacggaauuacacgaugaaccucgcuagucugaauuggaacaauuaugauccgacugaggaaauucccgccccucuugggacaccagacuucguaggaaagauccaaggcguucugacccagacuacaaagggcgacgggagcacccgcggacacaaggcuacgguguacaccgguucugcccccuuuacaccuaaauugggcuccguccaguucucaacugauaccgagaacgacuuugaagcacaucagaauacaaaguucacuccagugggggucauccaagauggaagcaccacacaccgaaacgagccccagcagugggugcucccgaguuacucuggcagaaauguucaaaacgugcaccuggccccugcuguagcgccaaccuuucccggugaacaguuacuguucuuuagguccacuaugccuggguguagcggcuaucccaauauggaccucgauugccuucugccacaggaguggguccagcauuucuaccaagaggcagccccugcucagucggacguggccuugcuacgguuuguuaaccccgauacgggacgugugcuguucgaauguaaacuccacaagucuggcuaugucacaguggcacauaccgggcagcacgaccugguaauuccaccgaacggauacuuucgcuucgauuccugggugaaucaguucuauacucuugccccuauggguaacggcaccgggagaaggcgguga

SEQ ID NO: 20370 - RNA, 1617 nt, Artificial Sequence
  derived and/or modified sequence opt3 from VP1__Norovirus_and/or_Norovirus-like__AB541202
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucgugcuagcgggaaacgcauuuacugccggcaaaauuaucuucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccauuuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuaccggcagccggaacuacacgaugaaucucgccacucagaacuggaacucuuaugaucccacagaggaaaucccugcaccacuggguacccccgacuucguugggaagauucagggagugcuuacucagacaacccgcgcugacggcuccacgcgaggccacaaggccaccgucuacacagggucagcugauuuugccccuaagcugggaagagugcaauucgcaacugacaccgauaaugacuuugaugccaaucagaacacaaaauucacuccagucggugugauccaggacggcgauaccgcucauaggaaugagccccaacaguggguuuugccgagcuacagugggcggaacaaucacaacgugcaccucgcgccugcaguagccccaacauuucccggagaacagcuguuauucuuucguucuaccaugccuggcuguuccgguuaucccaauauggaccuggauugccuccuuccacaggaguggguccaauacuucuaucaggaagcugccccugcacagagcgacguggcccuguugcgcuuuguuaaccccgauacugggagagugcuauucgaguguaagcugcauaaaucgggcuacgucacgguggcucacacaggacagcaugaccucguaaucccaccgaacggcuauuuuagguucgacucuugggugaaucaauucuacacccuggccccuauggggaacggaacuggucggcgacgcuga

SEQ ID NO: 20371 - RNA, 1617 nt, Artificial Sequence
  derived and/or modified sequence opt3 from VP1__Norovirus_and/or_Norovirus-like__FJ514242
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacccaaccauuaaguugaucgcuaugcucuauacaccccugcgugccaacaaugcgggggaagauguguucacugucucaugcagaguucugaccaggccgagcccugacuuugauuucauuuuucucgugcccccaacaguagagagucggaccaaaccuuucacugugcccaucuuaacagucgaagagaugaccaacucccgcuuuccaauaccccuggagaaacuuuucacgggaccuucuagcgccuucgugguucagccacagaaugguagauguacuaccgacggcguguugcuggggacaacucaacuauccccggucaacauuugcaccuuuaggggagaugugacacauaucgcaggcucacggaauuacaccaugaaccucgcuagucugaauuggaacaauuaugaccccacggaagagguaccugccccacuugguacucccgauuucguugggaagauucagggagugcugacacagaccacuaagggcgacggcagcacacgcgggcacaaggcuaccgucuacacgggaucugccccuuuuaccccaaaauuggguuccgugcaguucucaacagacacugaaaacgauuuugagacccaucaaaauacaaaguucacucccgucggcgugauccaggacgggagcaccacacaccgaaacgaaccgcagcaauggguucucccuaguuacucuggaagaaaugugcagaacguacaccuggcaccagccgucgcucccaccuuuccuggcgagcaguuacuguucuuuagguccacuaugcccgguuguagcggguauccaaauauggaucucgacugccuucugccucaggagugggugcaacauuucuaccaggaagcggcacccgcccagucggauguugcuuugcuacgguuugugaacccagacacgggccguguccuguucgaguguaaacuccacaagucuggauaugugacaguagcccauaccggccagcacgaucuggugaucccgccuaacggguacuuucgcuucgacuccuggguuaaucaauucuauacucuugcacccaugggaaacgguaccggcagaaggcgguga

SEQ ID NO: 20372 - RNA, 1617 nt, Artificial Sequence
  derived and/or modified sequence opt3 from VP1__Norovirus_and/or_Norovirus-like__KX353976
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaagugaucuucgccgcaguaccuccaaacuuuccgacugagggccucucccccucucagguuacgauguucccucauauuaucguggacguccgccaacuggagccagugcuuauaccccugccugauauccgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucggcacagacacugauaacgacuuugagacccaucaaaauacaaaguucacuccugugggggucauccaggauggaagcaccacacaccgaaacgaaccacagcaaugggugcuccccaguuacucuggcagaaauguucagaacgugcaccuggcaccggccguagcuccuaauuuuccaggugagcaguuacuguucuuuagguccaccaugcccggguguagcggcuauccuaacauggaccucgauugccuucugccccaggaauggguccaacauuucuaccaggaggcggcaccagcccagucggacguggcuuugcuacgguuuguuaacccugauacuggacgugugcuguucgaguguaaacuccacaagucuggcuaugucacgguggcccauacagggcagcacgaccugguaauucccccaaauggauacuuucgcuucgauuccugggugaaccaauucuauacccuugcaccgauggguaauggcacugggagaaggcgguga

SEQ ID NO: 20373 - RNA, 1617 nt, Artificial Sequence
  derived and/or modified sequence opt3 from VP1__Norovirus_and/or_Norovirus-like__KX353952
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucacugugccuaucuuaacagucgaggaaaugaccaauagccgcuuucccauaccacuggagaaacuuuucacgggacccuccucagccuucgugguucagccucagaacgguagauguacuaccgauggcguguugcuggggacaacucaacuaaguccagucaaugugugcaccuuuaggggagacguaacacauauugcaggcagccggaacuacaccaugaaucucgcuucucugaacuggaauaacuaugauccgacggaggaaauccccgccccucuugguacuccagacuucguugggaagauucagggagugcugacacagaccacuaagggcgacggcuccacacgcgggcacaaggcuaccgucuacacgggaucagccgauuuuacccccaaauuggguagcgugcaguucggcacagacacugagaaugauuuugaaacccaucaaaacacacgauucacuccugucggggugauccaggacggaaguaccacacacagaaaugagccacagcaauggguucuccccucuuacuccggcaggaacgugcacaauguacaucuggcaccggccgucgcuccuaacuuuccaggugaacaguuacuguucuuucggagcaccaugcccggguguucgggcuauccuaauauggaucucgacugccuucugccccaggagugggugcagcacuucuaccaagaggcggcaccagcccagucugauguugcuuugcuacguuuugugaacccugacacuggacgcguccuguucgaauguaagcuccauaaauccggcuaugugacgguagcccacacagggcagcacgaucuggugauucccccaaacggauacuuuagauucgacucauggguuaaucaguucuauacccuugcaccgauggguaacggcacugggaggcggcgauga

SEQ ID NO: 20374 - RNA, 1617 nt, Artificial Sequence
  derived and/or modified sequence opt3 from VP1__Norovirus_and/or_Norovirus-like__KR131771
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggaacaauuacgauccgacugaggaaauucccgccccucuggguacaccagacuuuguagggaagauccagggaaugcuuacccagacuacacgaagcgacggcucuaccagaggccacaaagcuacgguucugaccggguccgccgauuucgcacccaaguugggaagggugcaauuugccacagacacugauaacgacuucgagucaggucagaauaccaaguuuacaccugucggcgugauccaggaugggagcacuacccaucggaacgaaccacaacaguggguccuccccaauuacaguggacguacaggccacaacgugcaccuggcuccggcgguugcaccuaccuauccaggugagcaguuacuguucuuucgcucuacuaugcccggguguuccggcuacccuaauauggaccucgauugccuucugccccaggaaugggugcaacauuucuaucaggaggccgcuccagcccagagcgacguagcauugcuaagauuugucaacccugauacgggaagggugcuguucgaguguaaacuccacaagucgggcuacguuacaguggcccauaccgggcagcacgaccuggucauucccccaaacggauauuuucgguucgauucuugggugaaucaauuuuacacucuugcuccgauggguaacggcaccgggcgacgcagauga

SEQ ID NO: 20375 - RNA, 1617 nt, Artificial Sequence
  derived and/or modified sequence opt3 from VP1__Norovirus_and/or_Norovirus-like__AB933729
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaucguguacaccgggucagcugauuuugccccuaagcugggaagaguccaauucgcaacagacacugauaaugacuuuggugccaaucagaacaccaaauucacaccagugggcgucauucaggauggggacacugcucauaggaaugagccccaacaguggguguugccgagcuacaguggacggaacucucacaauguucaccucgcgccugcaguggccccaaccuuucccggcgaacagcuguuauucuuucguuccacaaugccugguuguagcggguaucccaacauggaucuggacugccuccuuccacaggaguggguacaauacuucuaucaggaagcugccccugcacagucggaugucgcccuguugcgcuuugugaaucccgacaccggcagaguucuauucgaguguaagcugcauaaaucuggauacgugacugucgcucacacgggccagcaugaucucgugauaccaccgaacggguauuuuagguucgacuccuggguaaaccaauucuacacacuggccccuaugggaaaugguaccggccggcgacgcuga

SEQ ID NO: 20376 - RNA, 1617 nt, Artificial Sequence
  derived and/or modified sequence opt3 from VP1__Norovirus_and/or_Norovirus-like__AB933646
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucgggacuacaccaugaaucucgcuagccugaacuggaauaacuaugauccgacggaagagauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugaaaaugacuuugagacccaucaaaacacaaaguucacuccagugggcgucauccaggaugggggaaccacacaccgaaaugaaccccagcaaugggugcucccgaguuacucuggcagaaacguuccuaaugugcaccuggcaccagccguagcucccaccuuuccuggugagcaguuacuguucuuuagguccacuaugcccggguguagcggcuauccaaacauggaccucgauugccuucugccucaggaguggguccagcauuucuaccaagaagcggcacccgcccagucggagguggcuuugcuacgguuuguuaauccagacacgggacgugugcuguucgaauguaaacuccacaagucuggcuaugucacaguggcccauaccgggcagcacgaucugguaauuccgccuaacggauacuuucgcuucgacuccugggugaaccaguucuauacucuugcacccauggguaauggcaccgggagaaggcgguga

SEQ ID NO: 20377 - RNA, 1617 nt, Artificial Sequence
  derived and/or modified sequence opt3 from VP1__Norovirus_and/or_Norovirus-like__JX155742
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucggcacagacacugaaaaugauuuugagacccaucaaaacacaaaguucacuccagugggggucauccaggacggaggcaccacacaccgaaaugaaccccagcaaugggugcucccgaguuacucugguagaaacguuccuaaugugcaccuggcaccagccguagcucccaccuuuccuggggagcaguuacuguucuuuagguccacuaugcccggcuguagcggauauccaaacauggaucucgacugccuucugccucaggaguggguccagcauuucuaccaagaagcggcacccgcccagucggauguggcuuugcuacgguuuguuaauccagacacgggccgugugcuguucgaguguaaacuccacaagucuggguaugucacaguggcccauaccggacagcacgaucugguaauuccgccuaacgguuacuuucgcuucgacuccugggugaaccaguucuauacucuugcacccaugggcaaugggaccggaagaaggcgguga

SEQ ID NO: 20378 - RNA, 1617 nt, Artificial Sequence
  derived and/or modified sequence opt3 from VP1__Norovirus_and/or_Norovirus-like__JN400614
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccucauuuacccccaaauuggguagcguccaguucaguacagauacugagaacgacuuugaaacccaucaaaauacaaaguucacuccugugggcgucauccaggaugggucuaccacacaccgaaacgagccacagcaaugggugcuccccuccuacagcggaagaaauguucacaacgugcaucuggcaccggccguagcuccuaccuuuccaggcgaacaguuacuguucuuuaggucgacuaugcccgguuguucuggguauccuaauauggaccucgauugccuucugccccaggaguggguccagcacuucuaccaagaggcggcaccagcccaguccgacguggcuuugcuacgguuuguuaacccugauacgggccgugugcuguucgaauguaaacuccauaagucaggauaugucacaguggcccacaccggccagcacgaccugguaauucccccaaacggguacuuucgcuucgauaguugggugaaucaguucuauacucuugcaccgaugggaaacgguaccggcagaaggcgguga

SEQ ID NO: 20379 - RNA, 1617 nt, Artificial Sequence
  derived and/or modified sequence opt3 from VP1__Norovirus_and/or_Norovirus-like__JN400601
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacgggacuacaccaugaaucucgcuagucugaacuggaauaacuaugauccgacggaagagauucccgccccucuugggacuccagacuucguaggaaagauccagggcguucugacacagaccacuaagggcaaugggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuauauuacagucgcccacaccgggcagcacgaucuggugauaccaccgaacggauacuuucgcuucgacuccuggguaaaucaguucuauacucuugcaccuauggguaacggcaccgggagaaggcgguga

SEQ ID NO: 20380 - RNA, 1617 nt, Artificial Sequence
  derived and/or modified sequence opt3 from VP1__Norovirus_and/or_Norovirus-like__JQ613538
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacauuauagaccccuggaucagaaauaacuucguccaggcuccugguggcgaauuuacagugaguccaaggaaugcacccggggagauucuuuggagcgccccucugggaccagauuugaaccccuacuuaucccaccuggcucggauguauaauggcuacgccgguggguucgaaguucaggugauccuagcgggaaacgcauuuacugccggcaaaauugucuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccacaacuacaccaugaaucucgcaucucagaacuggaacuccuaugaucccacggaggaaauuccugcuccacuggguacucccgacuucguagggaagauccagggaguucuuacacagaccacucggacagacggcucaacccgcggccauaaggccacgguguacaccgggagcgcugaguuuaguccuaagcugggacgaauccaauucgccacagauacuaauaaugacuuugaugcaaaccagaauaccaaauucacaccagucggugugauucaggacggcgggacuacccacagaaacgaaccccaacagugggucuugccgucuuacuccggaaggaauacacacaacgugcaucucgccccugcuguugcgccaaccuuucccggcgagcagcuguuauucuuucggagcacucugccugguuguucgggguaucccaauauggaucucgacugccuucugccacaggaaugggugcaauacuucuaucaggaggcagccccugcucagucugauguagccuugcuacguuuugucaaccccgacacgggccgcgugcuguucgaguguaagcuccacaaauccggauacguuacaguggcacauaccggccagcacgaucuggucauaccaccgaacggguauuuuagauucgacucaugggugaaucaauucuacacucuugccccuaugggaaacgguaccggcaggcggcgauga

SEQ ID NO: 20381 - RNA, 1617 nt, Artificial Sequence
  derived and/or modified sequence opt3 from VP1__Norovirus_and/or_Norovirus-like__HM802543
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccagauucacaccagucggcgugguucaagauggggacaccacucaccagaaugaaccccagcaguggguguugccggauuacucuggaagggacucccacaacguacaucucgcuccugccgucgcaccaacguuucccggcgagcaacuguuauucuuucggagcacaaugccugguuguucgggguaccccaauaugaaccuggauugccuccuuccacaggaaugggugcagcacuucuaucaggagucugccccugcucaauccgacguugcgcuguugcguuuugugaaucccgauaccggccgcguccuauucgaguguaaacugcauaagucaggauacgugacuguagcacacaccggccagcacgaccucgugaucccaccgaacggguauuuuagauucgauaguuggguuaaccaguucuacacacuggccccuaugggaaauggugcuggcaggcggcgauga

SEQ ID NO: 20382 - RNA, 1617 nt, Artificial Sequence
  derived and/or modified sequence opt3 from VP1__Norovirus_and/or_Norovirus-like__AB541337
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacgggacuacacgaugaaucucgcuagucugaacuggaauaacuaugauccgacugaagagauucccgccccucuugggacaccagacuucguaggaaagauccaaggcguucugacccagacuacaaagggcgacgggagcacccgcggacacaaggcuacgguguacaccgguucugcccccuuuacaccuaaauugggcuccguccaguucucaacugauaccgaaaaugacuuugagacacaucagaacacuaaguucaccccagugggggucauccaagauggaggcacaacccaccgaaaugaaccccagcagugggugcucccgagcuacagugguagaaacguucacaaugugcaucuggccccugcaguagcuccaacuuuucccggggagcaauuacuguucuuuaggucuacgaugccuggcuguuccggauaucccaacauggaccucgauugccuucugccacaggaguggguccagcacuucuaccaggaagcggccccugcacaaagcgacguggcuuugcuacgguuuguuaaucccgauacaggccgugugcuguucgaguguaaacuccauaagucgggguaugucaccguggcccacacuggacagcacgaccugguaauuccaccgaacgguuacuuucgcuucgauucuugggugaaccaguucuauacccuugcaccuaugggcaaugggacaggaagaaggcgguga

SEQ ID NO: 20383 - RNA, 1617 nt, Artificial Sequence
  derived and/or modified sequence opt3 from VP1__Norovirus_and/or_Norovirus-like__AB541252
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucauugugcagccucagaaugguagauguacuaccgauggcguuuugcuggggacaacucaacuaucaccagugaacaucugcaccuuuaggggagacgucacacauauugcaggcagucggaauuacaccaugaaccucgcuagccugaauuggaacaauuaugauccgacggaggaaauccccgccccucuugguacuccagacuucguggggaagauccagggaguacugacacagaccacuaagggcgacggcucuacacgcgggcacaaggcuaccguuuacacgggauccgccgauuuuacccccaaauuggguucagugcaguucggcacagacacugagaacgauuuugaaacccaucaaaauacaaaguucacuccugucggggugauucaggacggaagcaccacacaccgaaacgagccacagcaauggguccuccccaguuacucuggcagaaaugugcacaacguucaucuggcaccggccguggcuccuaauuuuccaggugaacaguuacuguucuuuagguccaccaugcccggguguagcggcuauccuaacauggaucucgacugccuucugccccaggaguggguacagcacuucuaccaagaggcggcaccagcccagucggaugucgcuuugcuacgguuugugaacccugacacuggacguguucuguucgaauguaaacuccauaagucuggcuaugugacggucgcccacacagggcagcacgaucuggugauacccccaaauggauacuuucgcuucgacuccuggguaaaccaguucuauacccuugcaccgauggguaauggcacugggagaaggcgguga

SEQ ID NO: 20384 - RNA, 1617 nt, Artificial Sequence
  derived and/or modified sequence opt3 from VP1__Norovirus_and/or_Norovirus-like__GU270580
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcagucggaacuacacgaugaaucucgcaacucagaacuggaauagcuaugaucccacagaggaaauuccugcuccacuggguacccccgacuucguagggaagauccagggaguucuuacucagacaacccgcgccgacggcucuacgcgaggccacaaggcuaccguguacacaggguccgccgauuuuucaccuaagcugggaagaauccaauucgcaacugacaccgauaacgacuuugaugccaaucagaacacaaaauucacuccagucggugugauucaggacggcaauaccgcucauaggaacgagccccaacagugggucuugccgagcuacagugggcguaauucucacaacgugcaccucgcgccugcaguugccccaacauuucccggagaacagcuguuauucuuucgguccaccaugccuggcuguagcgguuaucccaauauggaucuggacugccuccuuccacaggagugggugcaauacuucuaucaggaagcugccccugcacagucggauguagcccuguugcgcuuugucaaccccgacacugggagagugcuauucgaguguaagcugcauaaaacgggcuacguuacaguggcucacaccggacagcaugaucucgucauaccaccgaacggcuauuuuagguucgacucuugggugaaucaauucuacacucuggccccuauggggaacggaaccggucggcgacgcuga

SEQ ID NO: 20385 - RNA, 1617 nt, Artificial Sequence
  derived and/or modified sequence opt3 from VP1__Norovirus_and/or_Norovirus-like__EU876882
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggaacaauuacgauccgacugaggaaauucccgccccucuggguacaccagacuuuguagggaagauccagggaaugcuuacccagacuacacgaagcgacggcucuaccagaggccacaaagcuacgguucugaccggguccgccgauuucgcacccaaguugggaagggugcaauuugccacagacacugauaacgacuucgagucaggucagaauaccaaguuuacaccugucggcgugauccaggaugggagcacuacccaucggaacgaaccacaacaguggguccuccccaauuacaguggacguacaggccacaacgugcaccuggcuccggcgguugcaccuaccuauccaggugagcaguuacuguucuuucgcucuacuaugcccggguguuccggcuacccuaauauggaccucgauugccuucugccccaggaaugggugcaacauuucuaucaggaggccgcuccagcccagagcgacguagcauugcuaagauuugucaacccugauacgggaagggugcuguucgaguguaaacuccacaagucgggcuacguuacaguggcccauaccgggcagcacgaccuggucauucccccaaacggauauuuucgguucgauucuugggugaaucaauuuuacacucuugcuccgauggguaacggcgccgggcgacgcagauga

SEQ ID NO: 20386 - RNA, 1617 nt, Artificial Sequence
  derived and/or modified sequence opt3 from VP1__Norovirus_and/or_Norovirus-like__AB933649
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguucugcccccuuuacaccuaaauugggcuccguccaguucucaacugacaccgaaaacgauuuugaggcacaucagaauacaaaguucacuccagugggggucauccaagacggaagcaccacacaccgaaacgaaccccagcagugggugcucccgaguuacucuggcgguaauguucaaaacgugcaccuggccccugcuguagcgccaaccuuucccggggagcaguuacuguucuuuagauccacuaugccuggcuguagcggauaucccaauauggaucucgacugccuucugccacaggaguggguccagcauuucuaccaagaagcagccccugcucagucggauguggccuugcuaagguuuguuaaccccgacacgggccgggugcuguucgaguguaaacuccacaagucuggguaugucacaguggcacauaccggacagcacgaucugguaauuccaccgaacgguuacuuucguuucgacuccugggugaaucaguucuauacucuugccccuaugggcaacgggaccggacgcagaagguga

SEQ ID NO: 20387 - RNA, 1617 nt, Artificial Sequence
  derived and/or modified sequence opt3 from VP1__Norovirus_and/or_Norovirus-like__JX439816
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuuagcccuaagcugggaagaguccaauucgccacugacaccgauaaugacuuugaugcaaaucagaacacaaaauucacuccagugggugucauccaggacggcgauaccgcccauaggaaugagccccaacaguggguguugccgaguuacucugggcggaacucccacaauguucaccucgcuccugcgguggcaccaacauuucccggagaacagcuguuauucuuucguagcaccaugccuggcuguucggguuaucccaacauggaccuggauugccuccuuccacaggaguggguacaauacuucuaucaggaagccgcuccugcccagucugacgucgcacuguugcgcuuugugaaucccgauacugggagaguucuauucgaguguaagcugcauaaauccggcuacgugacggucgcccacacaggacagcaugaccucgugauuccaccgaacggcuauuuuagguucgacucauggguaaaccaauucuacacccuggcuccuauggggaauggaacuggucggcgacgcuga

SEQ ID NO: 20388 - RNA, 1617 nt, Artificial Sequence
  derived and/or modified sequence opt3 from VP1__Norovirus_and/or_Norovirus-like__JX155739
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugagaacgacuuugaaacccaucaaaauacaaaguucacuccagugggcgucauccaggaugggaguaccacacaccgaaacgagccccagcaaugggugcucccgucuuacuccggaagaaauguucagaacgugcaccuggccccugcaguagcuccaaccuuucccggcgaacaguuacuguucuuuaggagcacuaugccugguuguucgggguaucccaauauggaccucgauugccuucugccacaggaguggguccaacauuucuaccaggaggcggccccugcacagucugacguggcuuugcuacgguuuguuaaccccgauacgggccgugugcuguucgaauguaaacuccacaaguccggauaugucacaguggcccauaccggccagcacgaccugguaauuccaccgaacggguacuuucgcuucgauucaugggugaaucaauucuauacucuugcaccuaugggaaacgguaccggcagaaggcgguga

SEQ ID NO: 20389 - RNA, 1617 nt, Artificial Sequence
  derived and/or modified sequence opt3 from VP1__Norovirus_and/or_Norovirus-like__HQ456338
augaagauggccagcaacgacgcuucccccucugauggcucagcagccaaucuggugccugaggucaacaaugaaguuauggcgcucgagccagugguaggggcugccaucgcagccccgguggcuggacagaaaaacgucauugaccccuggauaagaaauaacuucgugcaagcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaagaucauuuucgccgcagugccuccaaauuuuccgacugagggccucucucccucgcagguaacgauguucccucauaucauaguugacgugcgccagcuggagccaguccuuaucccccugccugaugugcgaaacaauuuuuaucacuacaaccaaucaaaugacagcaccauuaaauugaucgcuaugcucuauacaccacugcgugccaacaacgcgggggaagauguguucacugucaguugcagaguucugaccaggcccuccccggacuuugauuucauuuuucucgugccucccacaguagagucucggaccaagccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucagcuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccaaggcguucugacacagaccacuaaggccgacggcagcacacgcgggcacaaagcaaccguguacacgggaucugccgacuuuacccccaaguuggguuccguccaguucucaacagauacugaaaaugacuuugagacccaucagaacacaaaauucacuccugugggcgucauccaagaugggagcaccacacaccgaaaugaaccacagcagugggugcuccccaguuacucuggaagaaacguucacaaugugcaucuggcuccggcgguagcaccuaccuuuccaggcgagcaauuacuguucuuuagguccacuaugcccgguuguagcggguauccuaacauggaccucgauugccuucugccccaggaguggguccagcacuucuaccaggaagccgcuccagcccaaucggacguggcauugcuacgguuuguuaauccugauacgggccgugugcuguucgaguguaagcuccauaaaucuggauaugucacaguggcccacaccggccagcacgaccugguaauucccccaaacggguacuuucgcuucgauuccugggugaaccaguucuauacucuugcuccgaugggaaaugguaccggcagaaggcgguga

SEQ ID NO: 20390 - RNA, 1617 nt, Artificial Sequence
  derived and/or modified sequence opt3 from VP1__Norovirus_and/or_Norovirus-like__AB541359
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccugucuuaaccguggaagagaugacgaacucucgcuuucccaucccacuggagaaacuuuucacuggacccagcggugccuucguugugcagccucagaauggcagauguaccacagacggggucuugcugggaacuacccagcuauccccagugaacauaugcacauuuaggggcgauguaacccauauugcagguucacggaauuacacgaugaaccucgcuagucugaauuggaacaauuaugacccgacugaagagauccccgccccucuugggacaccagauuucguuggaaagauucaaggcgugcugacccagacuacaaagggcgacgggagcacccgcggacacaaggcuacggucuacaccgguucugcccccuuuacaccuaaauugggcuccgugcaguucucaacugacaccgaaaacgauuuugagacacaucagaauacuaaguucaccccagucggggugauccaagacggaagcacaacccaccgaaacgaaccccagcaguggguucucccgaguuacucuggcagaaaugugcacaacguacaucuggccccugcagucgcuccaacuuuucccggugagcaauuacuguucuuuagguccacgaugccuggguguagcggcuaucccaauauggaucucgacugccuucugccacaggagugggugcagcacuucuaccaggaagcggccccugcacaaucggagguugcuuugcuacgguuugugaaccccgauacaggacguguccuguucgaauguaaacuccauaagucuggcuaugugaccguagcccacacugggcagcacgaccuggugaucccaccgaacggauacuuucgcuucgauuccuggguuaaucaguucuauacccuugcaccuauggguaacggcacagggagaaggcgguga

SEQ ID NO: 20391 - RNA, 1617 nt, Artificial Sequence
  derived and/or modified sequence opt3 from VP1__Norovirus_and/or_Norovirus-like__AB541280
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcugcccugggaccugauuugaauccauacuuaagccaccuggcgcggauguauaacggcuacgccgguggguucgaagugcaggucauucuagcaggaaaugcuuuuacugccggcaaaaucauuuucgcagcugugcccccuaacuuuccaacggagggccucuccccgucucagguaaccauguucccccauaucauaguugacgugcgccagcuggagccuguccuuaucccacugcccgaugugcgaaauaacuuuuaucacuacaaucaaucgaacgacucaacaauuaaguugaucgccaugcucuauacuccucugcgugcgaacaaugccggggaagauguguucaccgucagcugcagaguucugacaaggccaagucccgacuuugauuucauuuuucucgugccgccuaccguagagucccggacuaaacccuucacagugccaaucuuaaccgucgaagagaugacgaacucucgcuuuccuauaccccuggagaaacuuuucacuggaccaagcggugcauucgugguucagccccagaauggcagauguaccacagacgggguguugcugggaacuacccagcuauccccugucaacauuugcacauuuaggggcgaugugacccauaucgcugguucacggaauuacacgaugaaccucgccagucugaauuggaacaauuaugacccaacugaagagauuccggcuccccuugggacaccugauuucguaggaaagauccaaggcguucugacccagacuacaaagggcgacgggagcacccgcggacacaaggccacgguguacaccgguucugcaccauuuacacccaaauugggcuccguccaguucucaacugacaccgaaaacgauuuugagacacaucagaauacuaaguucaccccugugggggucauccaagacggaagcacaacccaccgaaacgaaccacagcagugggugcuccccaguuacucuggcagaaauguucacaacgugcaucuggccccggcuguagcgccuacuuuuccaggugagcaauuacuguucuuuagguccacgaugcccggguguagcggcuauccuaauauggaucucgacugccuucugccccaggaguggguccagcacuucuaccaggaagcagccccagcucaaucggauguggccuugcuacgguuuguuaacccugacacaggacgugugcuguucgaguguaaacuccauaagucuggcuaugucaccguggcacacacugggcagcacgaucugguaauucccccaaacggauacuuucgcuucgacuccugggugaaucaguucuauacccuugccccgauggguaacggcacagggagaaggcgguga

SEQ ID NO: 20392 - RNA, 1617 nt, Artificial Sequence
  derived and/or modified sequence opt3 from VP1__Norovirus_and/or_Norovirus-like__AB541244
augaagauggccagcaacgacgcuaaucccuccgauggcucugcagccaaccuggugccugaggucaauaacgaagggauggcgcucgagccaguugugggagcugccaucgcagccccgguagcuggucagaccaaugugauugaccccuggauaagaaacaauuucguccaagcaccuggcggggaauuuacagugucaccaaggaacgcccccagugagauccuuuggagcgcuucccugggaccugauuugaauccauacuuaucucaccuggcccggauguauaacggcuacgcggguggguucgaaguucaggugauucuagcaggaaaugccuuuacugcuggcaaaaucauuuucgccgcagugcccccuaacuuuccaacggagggccucucgccgucacaggucaccauguucccccauaucauaguagacguucgccagcuggagccugugcuuaucccacugcccgauguccgaaauaacuuuuaucacuacaaucaaagcaacgacaguacaauuaaguugaucgcuaugcucuauacuccucugcgugccaacaaugcgggggaagauguguucaccguguccugcagaguccugacaaggccaucucccgacuuugauuucauuuuucucguuccgccuaccguggagagccggacuaaacccuucacaguaccaaucuuaaccguggaagagaugacgaacucccgcuuuccuauaccccuggagaaacuuuucacuggaccaucaggugccuucgucgugcagccccagaauggcagauguaccacagacgggguuuugcugggaacuacccagcuaaguccugugaacauuugcacauuuaggggcgaugucacccauaucgcagguagccggaauuacacgaugaaccucgcuucucugaauuggaacaauuaugacccaacugaagagauuccggcuccccuugggacaccugauuucgugggaaagauccaaggcguacugacccagacuacaaagggcaacggguccacccgcggacacaaggccacgguuuacaccgguucagccccauuuacacccaaauugggcagcgugcaguucaguacugacaccgaaaaugacuuugagacacaucagaacacuaaguucaccccugucggggugauccaagauggaucuacaacccaccgaaaugaaccacagcaguggguccuccccuccuacagcggcagaucggugcacaacguucaucuggcaccggccguggcuccuacuuuuccaggugagcaauuacuguucuuuaggucuacgaugcccggguguuccggcuauccuaauauggaccucgauugccuucugccccaggaguggguacagcacuucuaccaggaagcggcaccagcccaaucagacgucgcuuugcuacgguuugugaacccugauacaggacguguucuguucgaguguaaacuccauaagaguggcuaugugaccgucgcccacacugggcagcacgaccuggugauucccccaaacggauacuuucgcuucgauagcuggguaaaucaguucuauacccuugcaccgauggguaacggcacagggagaaggcgguga

SEQ ID NO: 20393 - RNA, 1617 nt, Artificial Sequence
  derived and/or modified sequence opt3 from VP1__Norovirus_and/or_Norovirus-like__AB541203
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucguagguucacggaauuacacgaugaaccucgcaagucugaauuggaacaauuaugacccgacugaagagauucccgcuccucuugggacaccagauuucguuggaaagauccaaggcgugcugacccagacuacaaagggcgacgggagcacccgcggacacaaggccacggucuacaccgguucugcucccuuuacaccuaaauugggcuccgugcaguucucaacugacaccgaaaacgauuuugaggcccaucagaauacaaaguucacuccagucggggugauccaagacggaagcaccacacaccgaaacgaaccccagcaguggguucucccgaguuacucuggcagaaaugugcaaaacguacaccuggccccugcagucgcuccaaccuuucccggugagcaguuacuguucuuuagguccacuaugccuggguguagcggcuaucccaauauggaucucgacugccuucugccacaggagugggugcagcauuucuaccaagaagcggccccugcacagucggauguugcuuugcuacgguuugugaaccccgacacgggacguguccuguucgaguguaaacuccacaagucuggcuaugugacaguagcccauaccgggcagcacgaucuggugauuccaccgaacggauacuuucgcuucgacuccuggguuaaucaguucuauacucuugcaccuauggguaacggcaccgggagaaggcgguga

SEQ ID NO: 20394 - RNA, 1617 nt, Artificial Sequence
  derived and/or modified sequence opt3 from VP1__Norovirus_and/or_Norovirus-like__GQ850882
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggaacaauuacgauccgacugaggaaauucccgccccucuggguacaccagacuuuguagggaagauccagggaaugcuuacccagacuacacgaagcgacggcucuaccagaggccacaaagcuacgguuuucaccggguccgccgauuuugcacccaagcugggaagggugcaauucgccacagacacugauaacgacuuugagucaggucagaauaccaaguucacaccugucggcgugauccaggaugggagcacuacccaucggaacgaaccacaacagugggucuugcccaauuacaguggacguacaggccacaacgugcaccucgcuccggcgguugcaccuaccuauccaggugagcagcuguuauuuuuccgcucuacuaugcccggguguuccggcuacccuaauauggaccuggauugccuccuuccccaggaaugggugcaacauuuuuaucaggaggccgcuccagcccagagcgacguagcacuguugagauucgucaacccugauacgggaagggugcuauuugaguguaaacugcacaagucgggcuacguuacaguggcccauaccgggcagcacgaccucgucauucccccaaacggauauuuccgguuugauucuugggugaaucaauucuacacucuggcuccgauggguaacggcaccgggcgacgcagauga

SEQ ID NO: 20395 - RNA, 1617 nt, Artificial Sequence
  derived and/or modified sequence opt3 from VP1__Norovirus_and/or_Norovirus-like__KR131772
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucacgggcagucggaacuacacuaugaaucucgccacacagaacuggaauagcuaugaucccaccgaggaaauuccugcaccacuggguacucccgacuucguagggaagauccagggaguucuuacacagaccacgcgcgcugacggcucuacccgaggccacaaggccacaguguacacuggguccgcugauuuugccccuaagcugggaagaguccaauucgcaaccgacacagauaacgacuuugaugccaaucagaacacuaaauucaccccagugggugucauccaggacggcaauacagcucauaggaacgagccccaacaguggguguugccgucauacagcgggcggaauagucacaacguucaccucgcgccugcaguggccccaaccuuucccggagaacagcuguuauucuuucguucuacuaugccuggcuguuccgguuaucccaauauggaucuggacugccuccuuccacaggaguggguacaauacuucuaucaggaagcugccccugcacagagcgaugucgcccuguugcgcuuugugaaccccgacacggggagaguucuauucgaguguaagcugcauaaaucgggcuacgugacagucgcucacaccggacagcaugaucucgugauuccaccgaacggcuauuuuagguucgacucuuggguaaaucaauucuacacucuggccccuauggggaacggaaccggucggcgacgcuga

SEQ ID NO: 20396 - RNA, 1617 nt, Artificial Sequence
  derived and/or modified sequence opt3 from VP1__Norovirus_and/or_Norovirus-like__KR904215
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccaucuuaacugucgaggaaaugacaaauagccgcuuuccaauaccccuggagaaacuuuucaccggaccuuccucagccuucgugguucagccacagaacgguagauguacgacugauggcguguugcuggggaccacacaacuaaguccggucaauauuugcacuuuuaggggagacgugacccauacaaccggcagccacaacuacacgaugaaucucgcaacucagaacuggucuuccuaugaucccacagaggaaaucccugcuccacuggguacccccgacuucguagggaagauucagggaguucuuacucagacaaccaagacggacggcucaacccggggccauaaggccacaguguacacugggagcgcugauuuugccccuaaacugggacgcguccaauucgcaaccgacacagauaaugacuuugaggccaaccagaauacuaaguucaccccagugggugucauccaggauggcaacacagcucaccgaaaugaaccccaacaguggguguugccgaguuacucugggagaaacacccacaauguucaucucgcgccugcaguggccccaacuuuucccggagagcagcuguuauucuuuagguccacgaugccuggcuguagcgguuaucccaacauggaccuggauugccuccuuccacaggaauggguacaauacuucuaucaggaggcugccccugcacagucggacgucgcccuguugcgguuugugaaucccgauacagggcguguucuauucgaguguaaacugcacaagucuggcuacgugaccgucgcucauacuggaccacacgaccucgugaucccgccuaacggcuauuuucgcuucgauuccuggguaaaccaguucuacacccuggcccccauggggaauggaacagguagaaggcgguga

SEQ ID NO: 20397 - RNA, 1617 nt, Artificial Sequence
  derived and/or modified sequence opt3 from VP1__Norovirus_and/or_Norovirus-like__AB933715
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucggcacagacacugaaaacgauuuugagacccaucaaaauacaaaguucacuccagugggggucauccaggacggaggcaccacacaccgaaacgaaccccagcaaugggugcucccgagcuacagugguagaaauguuccuaacgugcaccuggcaccagccguagcucccaccuuuccuggggagcaguuacuguucuuuaggucuacuaugcccggcuguuccggauauccaaauauggaucucgacugccuucugccucaggaguggguccagcauuucuaccaagaagcggcacccgcccagagcgauguggcuuugcuacgguuuguuaacccagacacgggccgugugcuguucgaguguaaacuccacaagucgggguaugucacaguggcccauaccggacagcacgaucugguaauuccgccuaacgguuacuuucgcuucgacucuugggugaaucaguucuauacucuugcacccaugggcaacgggaccggaagaaggcgguga

SEQ ID NO: 20398 - RNA, 1617 nt, Artificial Sequence
  derived and/or modified sequence opt3 from VP1__Norovirus_and/or_Norovirus-like__AB933695
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucagucgaacgacucaacgaucaaguugauugcuaugcucuauaccccacugcgugccaacaaugcgggggaagauguguucacagucagcugcagaguucugacuaggcccaguccggacuuugauuucaucuuucucgugccucccaccguagagucccggacaaaaccauucaccgugccuauauuaacugucgaagagaugacaaacucucgcuuucccauuccacuggagaaacuuuucaccggacccagcuccgccuucgugguucagccucagaaugguagauguacgacugacggcguguugcuggggaccacacaacuaucaccagucaacaucugcacuuuuaggggagaugugacccauauugcaggcagucacaauuacacaaugagccucgcuucucugaacuggaauaacuaugacccgaccgaagagauccccgccccucuugguacgccagauuucguagggaagauccagggaguucugacucagacaaccaagggcgacggcuccacucgggggcauaaggcuacaguguacaccggaucagcccccuuuacgccuaaauuggguagcguccaguucaguaccgacacagaaaaugauuuugagacucaccaaaacaccaaguucacaccagugggcgucauucaggacgggggaacuacccaccgcaaugaaccccagcaaugggugcucccgucuuacuccggccgaaacguuccuaaugugcaucuggcaccagccguagcucccacauuuccuggugagcaguuacuguucuuuagaagcaccaugcccggguguucgggcuauccaaacauggaucucgacugccuucugccucaggaguggguccagcacuucuaccaagaagcggcacccgcccagucugauguggcuuugcuaagguuuguuaauccagacacuggacgggugcuguucgaguguaaacuccauaaguccggcuaugucacgguggcccacacagggcagcacgaucugguaauaccgccuaacggauacuuucguuucgacucaugggugaaccaguucuauacccuugcacccauggguaauggcacugggcgcagaagguga

SEQ ID NO: 20399 - RNA, 1617 nt, Artificial Sequence
  derived and/or modified sequence opt3 from VP1__Norovirus_and/or_Norovirus-like__AB933681
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucgggacuacaccaugaaucucgcuagccugaacuggaauaacuaugauccgacggaagagauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugaaaaugacuuugagacccaucaaaacgcaaaguucacaccagugggcgucauccaggaugggaguacuacccaccgaaaugaaccccagcaaugggugcucccgucuuacuccggaagaaacguuccuaaugugcaccuggccccagcuguagcgcccacauuuccuggcgagcaguuacuguucuuuaggagcaccaugcccgguuguucgggguauccaaacauggaccucgauugccuucugccucaggaguggguccagcauuucuaccaagaagcagcccccgcucagucugacguggccuugcuacgguuuguuaauccagauacuggccgugugcuguucgaguguaaacuccacaaguccggauaugucacgguggcacauacaggccagcacgaccugguaauuccgccuaacggguacuuucgcuucgauucaugggugaaccaguucuauacccuugcccccaugggaaaugguacuggcagaaggcgguga

SEQ ID NO: 20400 - RNA, 1617 nt, Artificial Sequence
  derived and/or modified sequence opt3 from VP1__Norovirus_and/or_Norovirus-like__AB933675
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccugucuuaacaguggaagagaugaccaacucucgcuuucccaucccacuggagaaacuuuucacgggacccagcuccgccuucguugugcagccucagaaugguagauguacuaccgacggcgucuugcuggggacaacucaacuaucaccagugaacauaugcaccuuuaggggagauguaacacauauugcaaauagucacaacuacaccaugaaucucgcuagccugaacuggaauaacuaugacccgacggaagagauccccgccccucuuggcacuccagauuucguugguaagauucagggggugcugacacagaccacuaagggagacggcucuacacggggccauaaggcuaccgucuacacgggguccgcccccuuuaccccuaaauugggaucagugcaguucagcacagacacugaaaaugauuuugagacccaccaaaacacaaaguucacuccagucggugugauccaggacggcgggaccacacaccgcaaugaaccccagcaauggguucucccgaguuacucuggacgaaacgugcagaauguacaucuggccccugcagucgcuccaaccuuucccggcgagcaguuacuguucuuuagauccacuaugccugguuguagcggguaucccaacauggaucucgacugccuucugccacaggagugggugcaacacuucuaccaggaagcggccccugcacagucggauguugcuuugcuaagguuugugaaccccgacacgggccggguccuguucgaguguaaacuccauaagucuggauaugugacaguagcccacaccggccagcacgaucuggugaucccaccgaauggguacuuucguuucgacuccuggguuaaccaauucuauacucuugcaccuaugggaaaugguaccggccgcagaagguga

SEQ ID NO: 20401 - RNA, 1617 nt, Artificial Sequence
  derived and/or modified sequence opt3 from VP1__Norovirus_and/or_Norovirus-like__AB933652
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccacuuucgugguucagccucagaaugguagauguaccacagacggcguguugcuggggacuacccaacuaucaccagucaacauuugcacauuuaggggagaugugacccauaucgccggcagucggaauuacacgaugaaccucgcaagccugaauuggaacaauuaugacccgacugaagagauucccgcuccucuugguacaccagauuucguagggaagauccagggaguucugacccagacuacaaagggcgacggcucuacccgcgggcacaaggccacgguguacaccggauccgcucccuuuacaccuaaauuggguucaguccaguucggcacugacaccgaaaacgauuuugagacacaucaaaauacuaaguucaccccagugggggucauccaggacggaggcacaacccaccgaaacgaaccccagcaaugggugcucccgagcuacagugguagaaauguuccuaacgugcaccuggccccagcaguagcccccacuuuuccuggggagcaguuacuguucuuuaggucuacgaugcccggcuguuccggauauccaaauauggaucucgacugccuucugccucaggaguggguccagcauuucuaccaagaagcugcgcccgcacagagcgauguggccuugcuacgguuuguuaacccagacacaggccgugugcuguucgaguguaaacuccacaagucgggguaugucaccguggcucauacuggacagcacgaucugguaauuccgccuaacgguuacuuucgcuucgacucuugggugaaucaguucuauacccuugcccccaugggcaacgggacaggaagaaggcgguga

SEQ ID NO: 20402 - RNA, 1617 nt, Artificial Sequence
  derived and/or modified sequence opt3 from VP1__Norovirus_and/or_Norovirus-like__KF429762
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccuaucuuaacugucgaggaaaugacaaacagccgcuuucccauaccacuggagaaacuuuucaccggacccuccucaacguucgugguucagccucagaaugguagauguacuaccgauggcguguugcuggggacaacucaacuaaguccagucaacauuugcaccuuuaggggagacgugacacauaucaccggcagccggaauuacacgaugaaccucgccucucagaauuggaacuccuaugauccgacugaggaaauucccgcaccucuggguacaccagacuucguagggaagauccagggaguucuuacccagacuacacgcaccgacggcucaacgcgaggccacaaggcuaccguguacacagggagcgccgauuuuagucccaagcugggaagaguccaauucgcuacugacaccgauaaugacuuugaugccaaccagaauacaaaauucacuccugugggugucauccaggacggcgggaccacacauaggaacgagccacaacaguggguguugcccucuuacuccggacggaauacccacaacguucaccucgcaccggccguggcuccuacuuuuccaggcgaacagcuguuauucuuucguagcacgaugcccgguuguucgggguauccuaauauggaucuggacugccuccuuccccaggaguggguacaacauuucuaccaggaagcggcaccagcccagucugaugucgcucuguugcgcuuugugaacccugacacaggcagaguucuauucgaguguaagcugcacaaauccggauaugugaccgucgcccauacuggccagcacgaucucgugauucccccaaacggguacuuuagguucgacucauggguaaaucaauucuauacccuggcaccgaugggaaacgguacaggccggcgacgcuga

SEQ ID NO: 20403 - RNA, 1617 nt, Artificial Sequence
  derived and/or modified sequence opt3 from VP1__Norovirus_and/or_Norovirus-like__JX644027
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagaguccaaaaccaagccauucacugugccuaucuuaacagucgaagagaugaccaacucucgguuucccauaccacuggagaaacuuuucacgggacccagcuccgccuucgugguucagccucagaauggucgcuguacuaccgacggcguguugcuggggacaacucaacuaucaccagucaacauuugcaccuuuagaggagaugugacacauaucgcaggcaguaggaauuacaccaugaaccucgcuagccugaauuggaacaauuaugacccgacggaagagauucccgccccucuugguacuccagauuucguagggaagauccagggaguucugacacagaccacuaagggcgacggcucuacacgggggcacaaagcuaccguguacacgggauccgcccccuuuaccccuaaguuggguucaguccaguucagcacagacacugaaaacgauuuugagacccaucaaaauacaaaauucacuccagugggcgucauccaggacgggaguaccacacaccgcaacgaaccccagcaaugggugcucccgucuuacuccggacgaaaugcacagaacguucaccuggccccugcuguggcgccaaccuuucccggcgagcaguuacuguucuuuagaagcacuaugccugguuguucgggguaucccaauauggaucucgacugccuucugccacaggaguggguacaacauuucuaccaggaagcagccccugcucagucugaugucgccuugcuaagguuugugaaccccgacacgggccggguucuguucgaguguaagcuccacaaauccggauaugugacagucgcacauaccggccagcacgaucuggugauuccaccgaacggguacuuucguuucgacucauggguaaaucaauucuauacucuugccccuaugggaaacgguaccggccgcagaagguga

SEQ ID NO: 20404 - RNA, 1617 nt, Artificial Sequence
  derived and/or modified sequence opt3 from VP1__Norovirus_and/or_Norovirus-like__JN400617
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgacuuuacccccaaauuggguuccguccaguucucaacagauacugaaaaugacuuugagacccaucaaaacacaaaguucacuccugugggcgucauccaggaugggagcaccacacaccgaaaugaaccacagcaaugggugcuccccaguuacucuggaagaaacguucagaaugugcaccuggcuccggcgguagcaccuaccuuuccaggcgagcaguuacuguucuuuagguccacuaugcccgguuguagcggguauccuaacauggaccucgauugccuucugccccaggaguggguccaacauuucuaccaggaagccgcuccagcccagucggacguggcauugcuacgguuuguuaauccugauacgggccgugugcuguucgaguguaaacuccacaagucuggauaugucacaguggcccauaccggccagcacgaccugguaauucccccaaacggguacuuucgcuucgauuccugggugaaccaauucuauacucuugcuccgaugggaaaugguaccggcagaaggcgguga

SEQ ID NO: 20405 - RNA, 1617 nt, Artificial Sequence
  derived and/or modified sequence opt3 from VP1__Norovirus_and/or_Norovirus-like__JQ613519
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgacuuuacccccaaauuggguuccguccaguucucaacagauacugaaaaugacuuugagacccaucaaaacacaaaguucacuccugugggcgucauccaggaugggaauaccacacaccgaaacgaaccacagcaaugggugcuccccagcuacaguggaagaaauguucacaacgugcaucuggcuccggcgguagcaccuaccuuuccaggcgagcaguuacuguucuuuaggucuacuaugcccgguuguuccggguauccuaauauggaccucgauugccuucugccccaggaguggguccagcacuucuaccaagaagccgcuccagcccagagcgacguggcauugcuacgguuuguuaacccugauacgggccgugugcuguucgaguguaaacuccauaagucgggauaugucacaguggcccacaccggccagcacgaccugguaauucccccaaacggguacuuucgcuucgauucuugggugaaucaguucuauacucuugcuccgaugggaaacgguaccggcagaaggcgguga

SEQ ID NO: 20406 - RNA, 1617 nt, Artificial Sequence
  derived and/or modified sequence opt3 from VP1__Norovirus_and/or_Norovirus-like__HQ456341
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaacucccgcuuuccaauaccccuggagaaacuuuucacgggaccuucaagugcguucgugguucagccacagaaugguagauguacuaccgauggcguguuuuuggggacaacucaacugagcccggucaacauuugcaccuucaggggagacgugacacauaucaccggcucucggaauuacacgaugaaccuagccacucagaauuggaacuccuaugaucccacagaggaaauuccugcaccacucgguacccccgacuuuguagggaagauccagggaguucugacucagacaacccgcgcugacggcucaacgcgaggccacaaggccaccguguacacagggagcgcugauuucgccccuaaacuuggaagaguccaauuugcaacugacaccgauaaugacuucgaugccaaccagaauacaaaguuuacuccagugggugucauccaggacggcgauaccgcucauaggaacgagccccaacagugggugcugccgaguuacucugggcguaauucccacaacguucacuuggcgccugcaguggccccaacauuccccggagaacagcuccuguuuuuccggagcaccaugccuggcuguucggguuaucccaauauggacuuagauugccugcucccacaggaguggguacaauacuuuuaucaggaagcugccccugcacagucugacgucgcccuucugcgcuucgugaaccccgauacugggagaguuuuguuugaguguaagcuacauaaauccggcuacgugacggucgcucacacaggacagcaugaccuggugauuccaccgaauggcuauuucagguucgacucauggguaaaccaauuuuacacccucgccccuauggggaacggaacuggucggcgacgcuga

SEQ ID NO: 20407 - RNA, 1617 nt, Artificial Sequence
  derived and/or modified sequence opt3 from VP1__Norovirus_and/or_Norovirus-like__HM802540
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguugagcaccgauacaaguaaugacuucgagacuggucagaacaccagauuuacaccagucggcgugguucaagaugggucuaccacucaccagaaugaaccccagcagugggugcucccggacuacuccggaagggauagccacaacguacaucuggcuccugccgucgcaccaacguuccccggcgagcaauuacuguuuuuccggucgacaaugccugguuguucuggguaccccaauaugaaccucgacugccuucugccacaggaaugggugcagcacuuuuaucaggaguccgccccugcucaaucagauguugcguugcuacguuucgugaaucccgacaccggccgcguccuguuugaguguaaacuccauaagaguggauacgugacuguagcacacaccggccagcacgaucuggugaucccaccgaacggguauuucagauuugacagcuggguuaaccaguucuacacacuugccccuaugggaaauggugcuggcaggcggcgauga

SEQ ID NO: 20408 - RNA, 1617 nt, Artificial Sequence
  derived and/or modified sequence opt3 from VP1__Norovirus_and/or_Norovirus-like__AB541257
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguucugcccccuuuacaccuaaauugggcuccguccaguucucaacugacaccgaaaacgauuuugaggcacaucagaauacaaaguucacuccagugggggucauccaagacggaagcaccacacaccgaaacgaaccccagcagugggugcucccgaguuacucuggcagaaaugcccaaaacguucaccuggcuccugcgguggcaccaaccuuucccggugagcaguuacuguucuuuagguccacuaugccuggguguagcggcuaucccaauauggaucucgacugccuucugccacaggaguggguacagcauuucuaccaagaagccgcuccugcccagucggaugucgcauugcuacgguuugugaaccccgacacgggacguguucuguucgaguguaaacuccacaagucuggcuaugugacagucgcccauaccgggcagcacgaucuggugauuccaccgaacggauacuuucgcuucgacuccuggguaaaucaguucuauacucuugcuccuauggguaacggcaccgggagaaggcgguga

SEQ ID NO: 20409 - RNA, 1617 nt, Artificial Sequence
  derived and/or modified sequence opt3 from VP1__Norovirus_and/or_Norovirus-like__AB541242
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuucccugggaccugauuugaacccauacuuaucucaccuggcccggauguauaauggcuacgcggguggguucgaagugcaggucauucuagcaggaaacgccuuuacagcuggcaaaaucauuuucgccgcagugcccccuaauuuuccaacugagggccucucgccgucacagguaacgauguucccccauaucauaguugacgugcgccaacuggagccuguccuuaucccacugcccgaugugcgaaacaauuuuuaucacuacaaccagagcaaugacaguaccauuaaguugaucgcuaugcucuauacaccucugcgugccaacaacgcgggggaagauguguucacugucuccugcagaguucugaccaggccaucucccgacuuugauuucauuuuucucgugccgccuacaguagagagccggaccaaacccuucacugugccaaucuuaacagucgaagagaugaccaauucccgcuuuccuauaccccuggagaaacuuuucacgggaccaucaagugccuucgugguucagccccagaacgguagauguacuaccgacggcguguugcuggggacaacucaacuaagcccugucaauauuugcaccuuuaggggagaugugacacauaucgcaggcucucggaacuacaccaugaaucucgcuucccugaacuggaauaacuaugacccaacggaagagauuccggcuccccuugguacuccugauuucguagggaagauccagggaguucugacacagaccacuaagggcgacggcucaacacgcgggcacaaggccaccguguacacgggaagcgccccauuuacccccaaauuggguaguguccaguucucuacagacacugaaaaugauuuugagacccaucaaaacacaaaguucacuccugugggcgucauccaggacgggggaaccacacaccgaaaugaaccacagcaaugggugcuccccuccuacagcggcagaaacguucagaaugugcaccuggcaccggccguagcuccuaccuuuccaggugagcaguuacuguucuuuaggucgacuaugcccggguguucuggcuauccuaacauggaucucgacugccuucugccccaggaguggguccaacauuucuaccaggaagcggcaccagcccaguccgauguggcuuugcuacgguuuguuaauccugacacgggacgugugcuguucgaguguaaacuccacaagucaggcuaugucacaguggcccauaccgggcagcacgaucugguaauucccccaaacggauacuuucgcuucgacaguugggugaaccaauucuauacucuugcaccgauggguaauggcaccgggagaaggcgguga

SEQ ID NO: 20410 - RNA, 1617 nt, Artificial Sequence
  derived and/or modified sequence opt3 from VP1__Norovirus_and/or_Norovirus-like__AB541225
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccgggacuacaccaugaaccucgcuucucugaauuggaacaauuaugauccgacggaagagauucccgccccucuugguacuccagacuucguagggaagauccagggaguucugacacagaccacuaagggcgacggcuccacacgcgggcacaaggcuaccguguacacgggaucagcccccuuuaccccuaaauuggguagcguccaguucaguacagauacuggcgacgauuuucaaacccaucagaacacaaaguucacuccagugggggucauccaggacggaggcaccacacaccgaaaugaaccccaacagugggugcucccgucuuacuccgguagaaacguuccuaaugugcaccuggcaccagccguagcucccaccuuuccuggggagcaguuacuguucuuuaggagcacuaugcccggcuguucgggauauccaaacauggaucucgacugccuucugccucaggaauggguccaacauuucuaccaggaggcggcacccgcccagucugauguggcuuugcuacgguuuguuaauccagacacgggccgugugcuguucgaguguaaacuccacaaggccggguaugucacaguggcacauaccggacagcacgaucugguaauuccgccuaacgguuacuuucgcuucgacuccugggugaaucaauucuauacucuugcccccaugggcaacgggaccggaagaaggcgguga

SEQ ID NO: 20411 - RNA, 1617 nt, Artificial Sequence
  derived and/or modified sequence opt3 from VP1__Norovirus_and/or_Norovirus-like__AB541190
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggaacaauuacgauccgacugaggaaauucccgccccucuggguacaccagacuuuguagggaagauccagggaaugcuuacccagacuacacgaagcgacggcucuaccagaggccacaaagcuacgguucugaccggguccgccgauuucgcacccaaguugggaagggugcaauuugccacagacacugauaacgacuucgagucaggucagaauaccaaguuuacaccugucggcgugauccaggaugggagcacuacccaucggaacgaaccacaacaguggguccuccccaauuacaguggacguacaggccacaacgugcaccuggcuccggcgguugcaccuaccuauccaggugagcaguuacuguucuuucgcucuacuaugcccggguguuccggcuacccuaauauggaccucgauugccuucugccccaggaaugggugcaacauuucuaucaggaggccgcuccagcccagagcgacauggcauugcuaagauuuguaaacccugauacgggaaggguccuguucgaguguaaacuccacaagucgggcuacgugacaguugcccauaccgggcagcacgaccuggugauucccccaaacggauauuuucgguucgauucuugggucaaucaauuuuacacucuugcuccgauggguaacggcaccgggcgacgcagauga

SEQ ID NO: 20412 - RNA, 1617 nt, Artificial Sequence
  derived and/or modified sequence opt3 from VP1__Norovirus_and/or_Norovirus-like__AB492092
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucaguggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcaauaccgcucauaggaacgagccccaacaguggguguugccgagcuacagugggcguaauucucacaacguucaccucgcgccugcaguggccccaacauuucccggagaacagcuguuauucuuucgguccaccaugccuggcuguagcgguuaucccaauauggaucuggacugccuccuuccacaggaguggguacaauacuucuaucaggaagcugccccugcacagucggaugucgcccuguugcgcuuugugaaccccgacacugggagaguucuauucgaguguaagcugcauaaaucuggcuacgugacggucgcucacacaggacagcaugaucucgugauuccaccgaacggcuauuuuagguucgacuccuggguaaaucaauucuacacccuggccccuauggggaacggaacuggucggcgacgcuga

SEQ ID NO: 20413 - RNA, 1617 nt, Artificial Sequence
  derived and/or modified sequence opt3 from VP1__Norovirus_and/or_Norovirus-like__EU916956
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccaaauucacaccagucggcgugguucaagaugggucuaccacucaccagaaugaaccccagcaguggguguugccggacuacuccggaagagauagccacaacguacaucucgcuccugccgucgcaccaacguuucccggcgagcaacuguuauucuuuaggucgacaaugccugguuguucuggguaccccaauaugaaccuggacugccuccuuccacaggaaugggugcagcacuucuaucaggaguccgccccugcucaaucagauguugcgcuguugcgguuugugaaucccgacaccggccguguccuauucgaguguaagcugcauaaaaguggauacgugacuguagcacacaccggccagcacgaucucgugaucccaccgaacggguauuuucgcuucgacagcuggguuaaccaguucuacacacuggccccuaugggaaauggugcuggcagaaggcgguga

SEQ ID NO: 20414 - RNA, 1617 nt, Artificial Sequence
  derived and/or modified sequence opt3 from VP1__Norovirus_and/or_Norovirus-like__EF126962
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauucguuugaucgcaaugcucuauacgccccugagagcuaacaacgccggggaugacguguucacagucucaugcaggguucugacccggccgagcccugauuuugacuucauuuuucucgugcccccaacuguagaaagucgcacaaagccuuucuccgugcccaucuuaaccgucgaggaaaugaccaauucuagauuuccaauaccccuggagaaacuuuucacuggaccuagcuccgcguucgugguucagccacagaacgguagguguaccacagauggcguguugcuggggacuacccaacuaucaccggucaauauuugcacauuucggggagacgugacccauaucgccggcacgcagaacuacacuaugaaucucgcaagucagaacuggaauaacuaugaucccacagaggaaguaccugcuccacuggguacccccgacuucguugggaagauucagggagugcuuacucaaacaacccgcggcgacggcagcacgcgagggcacaaagccaccgucucuacaggauccgugcauuuuacuccuaagcuggguucaguccaguucagcaccgauacaaguaaugacuuugagacuggccagaacaccagauucacaccaguggggguugugcaagauggaucuaccacucaccagaaugaaccccagcaguggguauugccggacuacuccggcagggauaaccacaauguccaucucgcuccugccguggcaccaacguuucccggugagcaacuguuauucuuucggagcacaaugccuggguguucgggcuaccccaacaugaaucuggacugccuccuuccacaggaauggguucagcacuucuaucaggagucugccccugcucaauccgauguggcgcuguugcguuuugucaaccccgacaccggacgcgugcuauucgaguguaagcugcauaaaucaggcuacguaacuguggcacacaccgggcagcacgaucucguuaucccaccgaacggauauuuuagauucgacaguugggucaaucaguucuacacacuggccccuauggguaacggcgcugggaggcggcgauga

SEQ ID NO: 20415 - RNA, 1617 nt, Artificial Sequence
  derived and/or modified sequence opt3 from VP1__Norovirus_and/or_Norovirus-like__AB663687
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucggcacagacacugagaacgauuuugaaacccaucaaaauacaaaguucacuccugugggggucauccaggacggaagcaccacacaccgaaacgagccacagcaaugggugcuccccaguuacucuggcagaaauguucacaacgugcaucuggcaccggccguagcuccuaauuuuccaggugaacaguucuuauuuuucagguccaccaugcccggguguagcggcuauccuaacauggaucuggacugccuccuuccccaggaguggguccagcacuuuuaccaagaggcggcaccagcccagucggauguggcucuguugcgguucguuaacccugacacuggacgugugcuauuugaauguaaacugcauaagucuggcuaugucacgguggcccacacagggcagcacgaucucguaauucccccaaauggauacuuccgcuucgacuccugggugaaccaguuuuauacccuggcaccgauggguaauggcacugggagaaggcgguga

SEQ ID NO: 20416 - RNA, 1617 nt, Artificial Sequence
  derived and/or modified sequence opt3 from VP1__Norovirus_and/or_Norovirus-like__AB933759
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcgauaccgcucauaggaaugagccccaacaguggguguugccgagcuacagugggcggaacucucacaauguucaccucgcgccugcaguggccccaacauuucccggagaacagcuguuauucuuucguuccaccaugccuggcuguagcgguuaucccaacauggaccuggauugccuccuuccacaggaguggguacaauacuucuaucaggaagcugccccugcacagucggacgucgcccuguugcgcuuugugaaucccgauacugggagaguucuauucgaguguaagcugcauaaaucuggcuacgugacggucgcucacacaggacagcaugaccucgugauuccaccgaacggcuauuuuagguucgacuccuggguaaaccaauucuacacccuggccccuauggggaauggaacuggucggcgacgcuga

SEQ ID NO: 20417 - RNA, 1617 nt, Artificial Sequence
  derived and/or modified sequence opt3 from VP1__Norovirus_and/or_Norovirus-like__AB933755
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucucugcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacgggaccuucaaguacuuucgugguucagccacagaacgguagauguaccacagauggcguguugcuggggacuacccaacuaagcccggucaauauuugcacauuuaggggagacgugacccauaucacgggcucucacaacuacacuaugaaucucgccucccagaacuggaacucauaugaucccacagaggaaauuccugcgccacuggguacccccgacuucguagggaagauccagggaguucuuacucagacaacccggacggacggcagcacccgcggccauaaggccacaguguacacugggagugcagaguuuucuccuaagcugggacgaguccaauucgcuaccgauacaaauaaugacuuugaugccaaccagaauacuaaauucaccccagugggugucauccaggacggcgggacaacccacagaaacgaaccccaacaguggguguugccguccuacagcggaaggaauacucacaacguucaucucgcuccugccguggcaccaacguuucccggcgagcagcuguuauucuuucggucgacaaugccugguuguucuggguaucccaauauggaucuggacugccuccuuccacaggaauggguacaacacuucuaccaggaggccgcuccugcgcaguccgaugucgcacuguugcguuuugugaaccccgacaccggccgcguucuauucgaguguaagcugcauaaaucaggauaugugacugucgcccacaccggccagcacgaucucgugauuccaccgaacggguacuuuagauucgacaguuggguaaaucaauucuauacacuggcuccuaugggaaacgguaccggcaggcggcgauga

SEQ ID NO: 20418 - RNA, 1617 nt, Artificial Sequence
  derived and/or modified sequence opt3 from VP1__Norovirus_and/or_Norovirus-like__AB933677
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucagucgaacgacucaacgaucaaguugauugcuaugcucuauaccccacugcgugccaacaaugcgggggaagauguguucacagucagcugcagaguucugacuaggcccaguccggacuuugauuucaucuuucucgugccucccaccguagagucccggacaaaaccauucaccgugccuauauuaacugucgaagagaugacaaacucucgcuuucccauuccacuggagaaacuuuucaccggacccagcuccgccuucgugguucagccucagaaugguagauguacgacugacggcguguugcuggggaccacacaacuaucaccagucaacaucugcacuuuuaggggagaugugacccauauugcaaguagccggaauuacacaaugaaccucgcuucucugaauuggaacaauuaugacccgaccgaagagauccccgccccucuuggcacgccagauuucguagguaagauccaggggguucugacucagacaaccaagggagacggcuccacucgcggccacaaggcuacaguguacaccgggucagcccccuuuacgccuaaauugggaagcguccaguucaguaccgacacagaaaacgauuuugagacucaucaaaauaccaaguucacaccagugggugucauucaggacggcgggacuacccaccgaaacgaaccccagcaaugggugcucccgucuuacuccggaagaaauguuccuaacgugcaccuggcaccagccguagcucccacauuuccuggcgagcaguuacuguucuuuaggagcaccaugcccgguuguucgggguauccaaauauggaucucgacugccuucugccucaggaguggguccagcauuucuaccaagaagcggcacccgcccagucugauguggcuuugcuacgguuuguuaacccagacacuggccgugugcuguucgaguguaaacuccacaaguccggauaugucacgguggcccauacaggccagcacgaucugguaauaccgccuaacggguacuuucgcuucgacucaugggugaaucaguucuauacccuugcacccaugggaaacgguacuggcagaaggcgguga

SEQ ID NO: 20419 - RNA, 1617 nt, Artificial Sequence
  derived and/or modified sequence opt3 from VP1__Norovirus_and/or_Norovirus-like__AB933650
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguucugcccccuuuacaccuaaauugggcuccguccaguucucaacugacaccgaaaacgauuuugaggcacaucagaauacaaaguucacuccagugggggucauccaagacggaagcaccacacaccgaaacgaaccccagcagugggugcucccgaguuacucuggcagaaauguucaaaacgugcaccuggccccugcuguagcgccaaccuuucccggugagcaguuacuguucuuuagguccacuaugccuggguguagcggcuaucccaauauggaucucgacugccuucugccacaggaguggguccagcauuucuaccaagaagcagccccugcucagucggauguggccuugcuacgguuuguuaaccccgacacgggacgugugcuguucgaguguaaacuccacaagucuggcuaugucacaguggcacauaccgggcagcacgaucugguaauuccaccgaacggauacuuucgcuucgacuccugggugaaucaguucuauacucuugccccuauggguaacggcaccgggagaaggcgguga

SEQ ID NO: 20420 - RNA, 1617 nt, Artificial Sequence
  derived and/or modified sequence opt3 from VP1__Norovirus_and/or_Norovirus-like__KM245071
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgacuuuacccccaaauuggguuccguccaguucucaacagauacugaaaaugacuuugagacccaucaaaacacaaaguucacuccugugggcgucauccaggaugggagcaccacacaccgaaaugaaccacagcaaugggugcuccccaguuacucuggaagaaacguucacaaugugcaucuggcuccggcgguagcaccuaccuuuccaggcgagcaguuacuguucuuuagguccacuaugcccgguuguagcggguauccuaacauggaccucgauugccuucugccccaggaguggguccagcacuucuaccaagaagccgcuccagcccagucggacguggcauugcuacgguuuguuaauccugauacgggccgugugcuguucgaguguaaacuccauaagucuggauaugucacaguggcccacaccggccagcacgaccugguaauucccccaaacggguacuuucgcuucgauuccugggugaaccaguucuauacucuugcuccgaugggaaaugguaccggcagaaggcgguga

SEQ ID NO: 20421 - RNA, 1617 nt, Artificial Sequence
  derived and/or modified sequence opt3 from VP1__Norovirus_and/or_Norovirus-like__KF712497
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaguaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagagcaacgacaguaccauuaaguugaucgcuaugcucuauacaccacugcgugccaauaacgcgggggaugacguguucacugucuccugcagaguucugaccaggcccucuccggauuuugacuucauuuuucucgugccucccacaguagaaagccggaccaaaccauucacugugccuaucuuaacagucgaggaaaugaccaacucccgcuuucccauaccacuggagaaacuuuucacgggacccucaagugccuucgugguucagccucagaaugguagauguacuaccgauggcguguugcuggggacaacucaacuaagcccagucaacauuugcaccuuuaggggagacgugacacauaucgcaggcucucggaauuacaccaugaaccucgcuucccugaauuggucaaacuaugauccgacggaggaaauucccgccccucuugguacuccagacuucguagggaagauccagggaguucugacacagaccacuaagggcgacggcagcacacgcgggcacaaggcuaccguguacacgggaagugccgauuuuacccccaaauuggguucuauccaguucgcaacagacacugagaaugauuuugaaacccaucaaaacacacgauucacuccugucggcgugauucaggacgggggaaccacacacagaaaugagccacagcaauggguccuccccuccuacagcggcaggaacgugcacaauguucaucuggccccggcuguggcgccuaacuuuccaggugaacaguuacuguucuuucggucgaccaugcccggguguucuggcuauccuaauauggaucucgacugccuucugccccaggaguggguacagcacuucuaccaagaggcagccccagcucaguccgaugucgccuugcuacguuuugugaacccugacacuggacgcguucuguucgaauguaagcuccauaaaucaggcuaugugacggucgcacacacagggcagcacgaucuggugauacccccaaauggauacuuuagauucgacaguuggguaaaccaguucuauacccuugccccgauggguaacggcacugggaggcggcgauga

SEQ ID NO: 20422 - RNA, 1617 nt, Artificial Sequence
  derived and/or modified sequence opt3 from VP1__Norovirus_and/or_Norovirus-like__KC990829
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucgcaacagacacugagaacgauuuugaaacccaucaaaauacaaaguucacuccugugggcgucauccaggacgggagcaccacacaccgaaacgagccacagcaaugggugcuccccaguuacucuggaagaaauguucacaacgugcaucuggccccggcuguagcgccuaauuuuccaggcgaacaguuacuguucuuuagguccaccaugcccgguuguagcggguauccuaacacugaucucgacugccuucugccccaggaguggguccagcacuucuaccaagaggcagccccagcucagucggauguggccuugcuacgguuuguuaacccugacacgggccgugugcuguucgaauguaaacuccauaagucuggauaugucacaguggcacacaccggccagcacgaucugguaauucccccaaauggguacuuucgcuucgacuccugggugaaccaguucuauacucuugccccgaugggaaaugguaccggcagaaggcgguga

SEQ ID NO: 20423 - RNA, 1617 nt, Artificial Sequence
  derived and/or modified sequence opt3 from VP1__Norovirus_and/or_Norovirus-like__JX439843
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaccaccggucaauauuugcaccuuuaggggagaugugacacauaucgcaggcagucggguauacaccaugaaccucgcuagccugaauuggaacaauuaugaccccacggaagagauuccugccccacuugguacucccgauuucguugggaagauccagggagugcugacacagaccacuaaggaagacggcucuacacgcggccacaaggcuaccgucuacacgggguccgccccuuuuaccccaaaauugggaucagugcaguucagcacagacacugagaacgauuuugaaacccaucaaaauacaaaguucacucccgucggugugauccaggacggcgggaccacacaccgaaacgagccgcagcaauggguucucccuaguuacucuggaagaaaugcaccaaacgugcaccuggcccccgcuguagcgccuaccuuucccggcgagcaguuacuguucuuuagguccacuaugccagguuguagcggguauccuaauauggaucucgacugccuucugccccaggaauggguccagcauuucuaccaagaggcagccccagcucagucggauguggccuugcuacgguuuguuaacccggacacgggccgugugcuguucgaauguaaacuccacaagucuggauaugucacaguggcacauaccggccagcacgaucugguaauuccucccaauggguacuuucgcuucgacuccugggugaaccaguucuauacucuugccccaaugggaaacgguaccggcagaaggcgguga

SEQ ID NO: 20424 - RNA, 1617 nt, Artificial Sequence
  derived and/or modified sequence opt3 from VP1__Norovirus_and/or_Norovirus-like__JX439841
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccgggacuacaccaugaaccucgcuucucugaauuggaacaauuaugauccgacggaagagauucccgccccucuugguacuccagacuucguagggaagauccagggaguucugacacagaccacuaagggcgacggcuccacacgcgggcacaaggcuaccguguacacgggaucaacccccuuuacaccuaaauuggguagcguccaguucaguacugauaccgaaaacgacuuugagacacaucaaaauacuaaguucaccccagugggcgucauccaggaugggggaacaacccaccgaaacgaaccccagcaaugggugcucccgucuuacuccggcagaaauguucagaacgugcaccuggccccugcaguagccccaacuuuucccggugagcaguuacuguucuuuaggagcacgaugccuggguguucgggcuaucccaauauggaccucgauugccuucugccacaggaguggguccaacauuucuaccaggaagcugcgccugcacagucugacguggccuugcuacgguuuguuaaccccgauacaggacgugugcuguucgaguguaaacuccacaaguccggcuaugucaccguggcucauacugggcagcacgaccugguaauuccaccgaauggauacuuucgcuucgauucaugggugaaccaauucuauacccuugccccuauggguaacggcacagggagaaggcgguga

SEQ ID NO: 20425 - RNA, 1617 nt, Artificial Sequence
  derived and/or modified sequence opt3 from VP1__Norovirus_and/or_Norovirus-like__JX439830
augaagaugggcagcaacgacgccaaucccuccgaugggucuaccgcuaaccuggugccugaggucaauaacgaaguuauggcacucgagccagugguaggagccgcgaucgcugccccgguggcaggucagcaaaaugucauugaccccuggauaagaaacaauuucgugcaggccccuggcggggaauuuacaguuucaccaaggaacgcucccggagagauccuuuggagugcaccucugggcccagauuugaaucccuacuuaagccaccuggcccggauguauaacgguuacgcugggggauucgaagugcaggucauucuagccggcaaugcguuuacugcaggcaaaaucauuuucgccgcugugccuccaaacuuuccgacggaggggcucucccccucucagguaaccauguucccucauaucauaguugacgugcgccaacuggagccaguccuuaucccccugccugaugugcgaaauaacuuuuaucacuacaaucagucgaacgacccaacaauuaaguugaucgccaugcucuauacuccccugcgugcaaacaaugcuggagaugacguguucaccgucucaugcagaguucugacaaggccgagcccugauuuugacuucauuuuucucgugcccccaaccguagaaagucggacuaaaccuuucuccgugcccaucuuaacagucgaggaaaugaccaacucucgcuuuccaauaccccuggagaaacuuuucacggguccuagcuccgccuucgugguucagccacagaauggcagauguacuaccgaugggguguugcugggaacaacucaacuaucaccggucaacauuugcaccuuuaggggcgacgugacacauaucaccgguagucggaauuacacgaugaaccucgcgacucagaauuggaacagcuaugaucccacagaggaaauuccugccccacuggggacccccgacuucguaggaaagauccagggcguucuuacucagacaacccgcgcagacggcucuacgcgagggcacaaggcuaccguguacacaggauccgccgauuuugcuccuaagcuggguagaguccaauucgccacugacaccgauaaugacuuugaugcaaaccagaauacaaaauucacuccagugggcgucauccaggacggggauaccgcccauaggaacgagccccaacaguggguguugccgucauacagcggacggaauagucacaacguucaccucgcuccugcgguggcaccaacauuucccggcgaacagcuguuauucuuucguucuaccaugccugguuguuccggguaucccaauauggaccuggauugccuccuuccacaggaguggguacaauacuucuaucaggaagccgcuccugcccagagcgacgucgcacuguugcgcuuugugaaccccgauacuggcagaguucuauucgaguguaagcugcauaaaucgggauacgugacggucgcccacacaggccagcaugaccucgugauuccaccgaacggguauuuuagguucgacucuuggguaaaucaauucuacacccuggcuccuaugggaaacgguacuggccggcgacgcuga

SEQ ID NO: 20426 - RNA, 1617 nt, Artificial Sequence
  derived and/or modified sequence opt3 from VP1__Norovirus_and/or_Norovirus-like__JX439828
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucgugcuagcgggaaacgcauuuacugccggcaaaauuaucuucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccauuuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuaccggcagccggaacuacacgaugaaucucgccacucagaacuggaacucuuaugaucccacagaggaaaucccugcaccacuggguacccccgacuucguugggaagauucagggagugcuuacucagacaacccgcgcugacggcuccacgcgaggccacaaggccaccgucuacacagggucagcugauuuugccccuaagcugggaagagugcaauucgcaacugacaccgauaaugacuuugaugccaaucagaacacaaaauucacuccagucggugugauccaggacggcgauaccgcucauaggaaugagccccaacaguggguuuugccgagcuacagugggcggaacucucacaaugugcaccucgcgccugcaguagccccaacauuucccggagaacagcuguuauucuuucguuccaccaugccuggcuguagcgguuaucccaacauggaccuggauugccuccuuccacaggaguggguccaauacuucuaucaggaagcugccccugcacagucggacguggcccuguugcgcuuuguuaaucccgauacugggagagugcuauucgaguguaagcugcauaaaucuggcuacgucacgguggcucacacaggacagcaugaccucguaaucccaccgaacggcuauuuuagguucgacuccugggugaaccaauucuacacccuggccccuauggggaauggaacuggucggcgacgcuga

SEQ ID NO: 20427 - RNA, 1617 nt, Artificial Sequence
  derived and/or modified sequence opt3 from VP1__Norovirus_and/or_Norovirus-like__JX445153
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacugggugcccccgacuucguagggaagauccagggaguucuuacccaaacuacacggggcgacggcagcacccgcgggcacaaggcuacggugucuaccggauccguccauuuuacaccuaagcuggguucagugcaguucagcacugauaccaguaaugacuuggagacaggccagaacacucgauuuaccccagucggggugguucaagauggaucuacaacccaccagaaugaaccccagcagugggugcucccgaacuacuccggcagagacagccacaauguacaucuggccccugcagucgccccaacuuuccccggugagcaauuacuguuuuucaggucgacgaugccuggguguucuggcuaccccaacaugaaucucgauugccuucugccacaggaaugggugcagcacuuuuaucaggaguccgcuccugcgcaaucagacguugcauugcuacgguucgugaaccccgauacaggacguguccuguuugaguguaaacuccauaagaguggcuacgugaccguagcccacacugggcagcacgaccuggugaucccaccgaacggauauuuccgcuuugauagcuggguuaaucaguucuacacccuugcuccuauggguaacggcgccgggagaaggcgguga

SEQ ID NO: 20428 - RNA, 1617 nt, Artificial Sequence
  derived and/or modified sequence opt3 from VP1__Norovirus_and/or_Norovirus-like__JX155754
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacccaaccauuaaguugaucgcuaugcucuauacaccccugcgugccaacaaugcgggggaagauguguucacugucucaugcagaguucugaccaggccgagcccugacuuugauuucauuuuucucgugcccccaacaguagagagucggaccaaaccuuucacugugcccaucuuaacagucgaagagaugaccaacucccgcuuuccaauaccccuggagaaacuuuucacgggaccuucuagcgccuucgugguucagccacagaaugguagauguacuaccgacggcguguugcuggggacaacucaacuauccccggucaacauuugcaccuuuaggggagaugugacacauaucgcaggcucacggaauuacaccaugaaccucgcuagucugaauuggaacaauuaugaccccacggaagagauuccugccccacuugguacucccgauuucguagggaagauccagggaguucugacacagaccacuaagggcgacggcagcacacgcgggcacaaggcuaccguguacacgggaucugccccuuuuaccccaaaauuggguuccguccaguucucaacagacacugaaaacgauuuugagacccaucaaaauacaaaguucacucccgugggcgucauccaggacgggggaaccacacaccgaaacgaaccgcagcaaugggugcucccuagcuacaguggcagagauguuccaaaugcacaccuggcccccgcuguggcgccuaccuuucccggugagcaguuacuguucuuuaggucuacuaugccaggguguuccggcuauccuaacauggaccucgauugccuucugccccaggaguggguacagcauuucuaccaagaagcagccccagcucagagcgacgucgccuugcuacgguuugugaauccggauacgggacguguucuguucgaguguaaacuccacaagucgggcuaugugacagucgcacauaccgggcagcacgaccuggugauuccucccaacggauacuuucgcuucgauucuuggguaaaccaguucuauacucuugccccaauggguaauggcaccgggagaaggcgguga

SEQ ID NO: 20429 - RNA, 1617 nt, Artificial Sequence
  derived and/or modified sequence opt3 from VP1__Norovirus_and/or_Norovirus-like__JN400608
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucacaauuacaccaugaaccucgcuagccugaauuggaacaauuaugacccgacggaagagauucccgccccucuugguacuccagauuucguagggaagauccagggaguucugacacagaccacuaagggcgacggcucuacacgggggcauaaggcuaccguguacacgggauccgcccccuuuaccccuaaauuggguucaguccaguucagcacagacacugaaaacgauuuugagacccaccaaaauacaaaguucacuccagugggcgucauccaggacgggaguaccacacaccgcaacgaaccccagcaaugggugcucccgucuuacuccggaggcaauguucauaacgugcaccuggccccugcaguagcuccaaccuuucccggugagcaguuacuguucuuucgaagcacuaugccuggguguucgggcuaucccaauauggaucucgacugccuucugccacaggaguggguccagcauuucuaccaagaagcggccccugcacagucugauguggcuuugcuaagauuuguuaaccccgacacgggaagggugcuguucgaguguaaacuccacaaguccggcuaugucacaguggcccacaccgggcagcaugaucugguaauuccaccgaacggauacuuucgguucgacucaugggugaaucaguucuauacucuugcaccuauggguaacggcaccgggcgucgcagauga

SEQ ID NO: 20430 - RNA, 1617 nt, Artificial Sequence
  derived and/or modified sequence opt3 from VP1__Norovirus_and/or_Norovirus-like__EF187497
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucguguucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaagaugucuucaccguuagcugcagagugcugacaaggccgaguccugacuuugauuucaucuuucucguacccccaaccguggagucccggacuaaaccuuucucuguccccauuuuaacaguggaagagaugaccaauagccgcuuuccaaucccccuggagaaacuuuucacgggaccuuccucaacuauaguugugcagccacagaacgguagauguaccacagacggcgucuugcuggggacuacccaacuaaguccggugaauauuugcacauucaggggagauguaacccauaucgcgggcacgcaggaauacacuaugaaccucgccagccagaauuggaacaauuaugaccccacagaggaaauuccugcaccacuggguacccccgauuuuguugggaagauccagggagugcuuacucaaacaacccggcgcgacggcucuacgcgaggccacaaggcuaccgucuccacagggucagugaacuucacuccuaagcugggaagaauccaguuuagcaccgacacaaguaaugauuucgagacuggucagucuaccagguuuacaccagucggcgugguucaagacggguccaccacucaucagaacgaaccccagcaguggguguugccggauuacagcggacgggacucgcacaauguacaccucgccccugcugucgccccaucuuuccccggcgagcaacuguuauuuuuccguuccacgaugccugguuguucaggguaccccaacaugaaucuggauugccuccuuccacaggagugggugcagcauuuuuaucaggaagcagccccugcucaaagugacguugcgcuguugcgcuucgugaaccccgauacaggcagaguccuauuugaguguaaacugcacaagagcggauacgugaccguagcacauacuggccagcacgaccucgugauuccaccgaauggguauuucagguuugauuccuggguuaaccaguucuacacccuggccccuaugggaaacgguacaggccggcgacgcuga

SEQ ID NO: 20431 - RNA, 1617 nt, Artificial Sequence
  derived and/or modified sequence opt3 from VP1__Norovirus_and/or_Norovirus-like__AB668028
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggucuaccacacaccgaaaugaaccccagcaaugggugcucccguccuacagcggaagaaacguucacaaugugcaucuggccccugcaguagcuccaaccuuucccggcgagcaguuacuguucuuuaggucgacuaugccugguuguucuggguaucccaacauggaucucgacugccuucugccacaggaguggguccagcacuucuaccaagaagcggccccugcacaguccgauguggcuuugcuacgguuuguuaaucccgacacgggccgugugcuguucgaguguaaacuccauaagucaggauaugucacaguggcccacaccggccagcacgaucugguaauuccaccgaacggguacuuucgcuucgacaguugggugaaccaguucuauacucuugcaccuaugggaaaugguaccggcagaaggcgguga

SEQ ID NO: 20432 - RNA, 1617 nt, Artificial Sequence
  derived and/or modified sequence opt3 from VP1__Norovirus_and/or_Norovirus-like__HM802542
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggcggauccagggaguucuuacucaaacaacccgccgagacggcagcacgagaggccacaaggccaccgugucuacaggguccguccauuuuacuccuaagcugggaucagugcaguucagcaccgauacaaguaaugacuuugagacuggucagaacaccagguucacaccagucggcgugguucaagaugggucuaccacucaccagaaugaaccccagcaguggguguugccggacuacuccggacgggauagccacaacguacaucucgcuccugccgucgcaccaacguuucccggcgagcaacuguuauucuuucguucgacaaugccugguuguucuggguaccccaauaugaaccuggacugccuccuuccacaggaaugggugcagcacuucuaucaggaguccgccccugcucaaucagauguugcgcuguugcgcuuugugaaucccgacaccggcagaguccuauucgaguguaagcugcauaaaaguggauacgugacuguagcacacaccggccagcacgaucucgugaucccaccgaacggguauuuuagguucgacagcuggguuaaccaguucuacacacuggccccuaugggaaauggugcuggccggcgacgcuga

SEQ ID NO: 20433 - RNA, 1617 nt, Artificial Sequence
  derived and/or modified sequence opt3 from VP1__Norovirus_and/or_Norovirus-like__HQ009513
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccaucuuaacagucgaggaaaugaccaacucucgcuuuccaauaccccuggagaaacuuuucacgggaccuagcuccgcguucgugguucagccacagaaugguagauguacuaccgauggcguguugcuggggacaacucaacuaucaccggucaacauuugcaccuuuaggggagacgugacacauaucaccggcagucggaauuacacgaugaaccucgccacucagaauuggaacagcuaugaucccacagaggaaauuccugcaccacuggguacccccgacuucguagggaagauccagggaguucuuacucagacaacccgcgcugacggcucuacgcgaggccacaaggccaccguguacacaggguccgcugauuuugccccuaagcugggaagaguccaauucgcaacugacaccgauaaugacuuugaugccaaccagaauacaaaauucacuccagugggugucauccaggacggcaacaccgcucauaggaaugagccccaacaguggguguugccgucauacagcgggcggaacagucacaauguucaccucgcgccugcaguggccccaacauuucccggagaacagcuguuauucuuucguucuaccaugccuggcuguuccgguuaucccaacauggaucuggacugccuccuuccacaggaguggguacaauacuucuaucaggaagcugccccugcacagagcgaugucgcccuguugcgcuuugugaaccccgacacugggagaguucuauucgaguguaagcugcauaaaucgggcuacgugacggucgcucacacaggacagcaugaucucgugauuccaccgaauggcuauuuuagguucgacucuuggguaaaccaauucuacacccuggccccuauggggaauggaacuggucggcgacgcuga

SEQ ID NO: 20434 - RNA, 1617 nt, Artificial Sequence
  derived and/or modified sequence opt3 from VP1__Norovirus_and/or_Norovirus-like__AB541322
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcgauaccgcucauaggaaugagccccaacaguggguguugccgagcuacagugggcggaacucucacaauguucaccucgcgccuacaguggcaccaaccuuucccggagaacagcuguuauucuuucguuccacuaugccuggcuguagcgguuaucccaacauggaccuggauugccuccuuccacaggaguggguacaauacuucuaucaggaagccgcuccugcccagucggacgucgcacuguugcgcuuugugaaucccgauacggggagaguucuauucgaguguaagcugcauaaaucuggcuacgugacagucgcccacaccggacagcaugaccucgugauuccaccgaacggcuauuuuagguucgacuccuggguaaaccaauucuacacucuggcuccuauggggaauggaaccggucggcgacgcuga

SEQ ID NO: 20435 - RNA, 1617 nt, Artificial Sequence
  derived and/or modified sequence opt3 from VP1__Norovirus_and/or_Norovirus-like__AB541321
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccacagaacgcacccagugagauccuuuggagcgccccucuggggccagauuugaaucccuacuuaucccaccuggcuaggauguauaacggauacgccggcgguuucgaagugcaggucauucuagcggggaaugcauuuacugccggaaaaaucauuuucgcugccgugccuccaaacuuuccgacggagggccucucucccucgcaaguaaccauguucccucauaucauaguugacgugcggcagcuggagccaguccuuaucccccugccugaugugcgcaauaacuuuuaucacuacaaucagucaaacgacccaacaauuaaguugaucgcaaugcucuauacuccccugcgagcuaacaaugccggcgaugacguguucaccgucagcugccguguucugacaagaccgaguccugauuuugacuucauuuuucucgugcccccaaccguagaauccaggacuaaaccuuucacagugcccaucuuaaccgucgaggaaaugacgaacucucgguuuccaauaccccuggagcgccuuuacacugggccuagcuccgcguucgugguucagccacaaaauggaagauguaccacagaugguguguugcugggcacuacccagcuaucagccgucaacauuugcacauucaggggagacgugacccauaucgcagggagucggaauuauacgaugaaccucgcuagccagaauuggaacaauuacgauccgacugaggaaauucccgccccucugggcacaccagacuuuguagguaagauccaggggaugcuuacccaaacuacacgcucugacggauccacccgaggccacaaagcuacgguucugaccggcucagccgauuucgcacccaaguuggggagagugcaguuugccacagacacugauaacgacuucgagagcggacagaauaccaaguuuacaccugucggugugauccaagauggcaguacuacccauaggaacgaaccacagcaguggguccuccccaauuacucugggcggacaggacacaacgugcaccuggcuccggcgguugcaccuaccuauccaggcgagcaguuacuguucuuucguuccacuaugcccgguuguagcggguacccuaauauggaccucgauugccuucugccccaagaaugggugcagcauuucuaucaggaggccgcuccagcccagucggacguagcauugcuacgcuuugucaacccugauacgggcagagugcuguucgaguguaaacuccacaagucuggauacguuacaguggcccauaccggccaacacgaccuggucauucccccaaacggguauuuuagguucgauuccugggugaaucaguuuuacacucuugcuccgaugggaaacgguaccggccggcgacgcuga

SEQ ID NO: 20436 - RNA, 1617 nt, Artificial Sequence
  derived and/or modified sequence opt3 from VP1__Norovirus_and/or_Norovirus-like__AB541253
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugagaacgacuuugaaacccaucaaaauacaaaguucacuccagugggcgucauccaggaugggaguaccacacaccgaaacgagccccagcaaugggugcucccgucuuacuccggaagaaauguucacaacgugcaucuggccccugcaguagcuccaaccuuucccggcgaacaguuacuguucuuuaggagcacuaugccugguuguucgggguaucccaauauggaccucgauugccuucugccacaggaguggguccagcacuucuaccaagaggcggccccugcacagucugacguggcuuugcuacgguuuguuaaccccgauacgggccgugugcuguucgaauguaaacuccauaaguccggauaugucacaguggcccacaccggccagcacgaccugguaauuccaccgaacggguacuuucgcuucgauucaugggugaaucaguucuauacucuugcaccuaugggaaacgguaccggcagaaggcgguga

SEQ ID NO: 20437 - RNA, 1617 nt, Artificial Sequence
  derived and/or modified sequence opt3 from VP1__Norovirus_and/or_Norovirus-like__AB541250
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaagacacaaaguucacuccagugggcgucauccaggaugggggaaccacacaccgaaacgaaccccagcaaugggugcucccgucuuacuccggcagaaauguucagaacgugcaccuggccccugcaguagcuccaaccuuucccggugagcaguuacuguucuuuaggagcacuaugccuggguguucgggcuaucccaauauggaccucgauugccuucugccacaggaguggguccaacauuucuaccaggaagcggccccugcacagucugacguggcuuugcuacgguuuguuaaccccgauacgggacgugugcuguucgaguguaaacuccacaaguccggcuaugucacaguggcccauaccgggcagcacgaccugguaauuccaccgaauggauacuuucgcuucgauucaugggugaaccaauucuauacucuugcaccuauggguaacggcaccgggagaaggcgguga

SEQ ID NO: 20438 - RNA, 1617 nt, Artificial Sequence
  derived and/or modified sequence opt3 from VP1__Norovirus_and/or_Norovirus-like__AB541211
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacauuaugaaccucgcuagccugaauuggaacaauuaugacccgaccgaagagauccccgccccucuugguacgccagauuucguagggaagauccagggaguucugacucagacaaccaagggcgacggcucuacucgcgggcacaaggcuacaguguacaccggauccgcccccuuuacgccuaaauuggguucaguccaguucagcaccgacacagaaaacgauuuugagacucaucaaaauaccaaguucacaccagugggcgucauucaggacgggaguacuacccaccgaaacgaaccccagcaaugggugcucccgucuuacuccggaagaaauguucacaacgugcaucuggccccugcaguagcuccaacauuucccggcgagcaguuacuguucuuuaggagcaccaugccugguuguucgggguaucccaauauggaucucgacugccuucugccacaggaguggguccagcacuucuaccaagaagcggccccugcacagucugauguggcuuugcuacgguuuguuaaccccgacacuggccgugugcuguucgaguguaaacuccauaaguccggauaugucacgguggcccacacaggccagcacgaucugguaauaccaccgaacggguacuuucgcuucgacucaugggugaaucaguucuauacccuugcaccuaugggaaacgguacuggcagaaggcgguga

SEQ ID NO: 20439 - RNA, 1617 nt, Artificial Sequence
  derived and/or modified sequence opt3 from VP1__Norovirus_and/or_Norovirus-like__GQ246797
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccggaacuacaccaugaaucucgcaacgcagaacuggaacucuuaugaucccacugaggaaauuccugcuccacuggguacacccgacuucguagggaagauccagggaguucuuacccagacuacacgcgccgacggcuccacccgaggccacaaggcuacgguguacaccgggucagccgauuuugcaccuaagcugggaagaguccaauucgccacagacacugauaaugacuuugaugcuaaucagaacaccaaauucacaccagugggugucauccaggacggcgauacugcgcauaggaaugagccccaacaguggguguugccgagcuacagugggcggaacucucacaauguucaccucgccccugcaguggcuccaaccuuucccggagaacagcuguuauucuuucguuccacaaugccuggcuguagcgguuaucccaacauggaccuggauugccuccuuccacaggaguggguacaauacuucuaucaggaagccgccccugcacagucggacgucgcucuguugcgcuuugugaaucccgauaccgggagaguucuauucgaguguaagcugcauaaaucuggcuacgugacugucgcccacacgggacagcaugaccucgugauuccaccgaacggcuauuuuagguucgacuccuggguaaaccaauucuacacacuggcaccuauggggaauggaaccggucggcgacgcuga

SEQ ID NO: 20440 - RNA, 1617 nt, Artificial Sequence
  derived and/or modified sequence opt3 from VP1__Norovirus_and/or_Norovirus-like__GQ246794
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagaucccuuggagcgccccacuuggacccgaucugaacccuuacuugucccacuuagcucggauguauaauggcuacgccgguggguucgaagugcaggucauucuggcgggaaacgcauuuacugccggcaaaaucauuuucgcugccgugccaccgaauuuucccacggagggccuaucuccuucgcagguaaccauguucccacauaucauaguugacgugcgccaacucgagcccguccugaucccucuuccagaugugcgaaacaauuuuuaucacuacaaccagucaaaugaccccacaauuaagcugaucgcaauguuguauacuccgcuccgugcuaacaacgccggggaugacguguucaccgucagcugcagaguucugacaaggccuagucccgauuuugacuucauuuuucuggugccaccuaccguagaaucccggacuaaacccuucucugugccaauccucacagucgaggaaaugaccaauagccgcuuucccauaccuuuagagaagcuguucacgggaccauccucagcguucgugguucagccgcagaacgguagauguacuaccgauggcgugcuuuuggggacaacucaacugagucccgucaauauuugcaccuuuaggggagacgugacacauaucaccggcagccggaacuacacgaugaaucuagccacucagaacuggaacucuuaugauccuacagaggaaauuccagcaccccucgguaccccugacuucguagggaaaauccagggaguucugacucagacaacccgcgcugacggcuccacgcgaggccacaaggccaccguguacacagggucagcugauuuugccccaaaacuuggaagaguccaauucgcaacugacaccgauaaugacuuugaugccaaucagaacacaaaguucacucccgugggugucauccaggacggcgauaccgcucauaggaaugagccgcaacagugggugcugccuagcuacagugggcggaacucucacaauguucacuuggcgccagcaguggcccccacauuuccuggagaacagcuccuguucuuucguuccaccaugcccggcuguagcgguuauccaaacauggacuuagauugccugcucccucaggaguggguacaauacuucuaucaggaagcugcccccgcacagucggacgucgcccuucugcgcuuugugaauccagauacugggagaguuuuguucgaguguaagcuacauaaaucuggcuacgugacggucgcucacacaggacagcaugaccuggugauuccgccuaacggcuauuuuagguucgacuccuggguaaaccaauucuacacccucgcccccauggggaauggaacuggucggcgacgcuga

SEQ ID NO: 20441 - RNA, 1617 nt, Artificial Sequence
  derived and/or modified sequence opt3 from VP1__Norovirus_and/or_Norovirus-like__EU876884
augaagauggccagcaacgacgcuaaucccuccgauggcucuaccgcaaaccuggugccugaggucaauucagaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucacagugcccaucuuaaccgucgaggaaaugacuaauucucgcuuuccaauaccccuggagagacuuuacacgggaccuagcuccgcguucgugguucagccacagaacgguagguguaccacagauggcguguugcuggggacuacccaacuaucagccgucaauauuugcacauuccggggagacgugacccauaucgcaggcagucgcaacuauacgaugaaucucgcuagccagaacuggaauaacuacgauccgacugaggaaauucccgccccucuggguacaccagacuuuguagggaagauccagggaaugcuuacccagacuacacgaucugacggcuccaccagaggccacaaagcuacgguucugaccgggucagccgauuucgcacccaaguugggaagggugcaauuugccacagacacugauaaugacuucgagagcggucagaacaccaaguuuacaccugucggcgugauccaggaugggaguacuacccaucggaaugaaccacaacaguggguccuccccucuuacuccggacguacaggccacaacgugcaccuggcuccggcgguugcaccuaccuauccaggugagcaguuacuguucuuucgcagcacuaugcccggguguucgggcuacccuaauauggaccucgauugccuucugccccaggaaugggugcaacauuucuaucaggaggccgcuccagcccagucugacguagcauugcuaagauuugucaacccugauacgggaagggugcuguucgaguguaaacuccacaaguccggcuacguuacaguggcccauaccgggcagcacgaccuggucauucccccaaauggauauuuucgguucgauucaugggugaaccaauuuuacacucuugcuccgauggguaacggcgccgggcgacgcagauga

SEQ ID NO: 20442 - RNA, 1617 nt, Artificial Sequence
  derived and/or modified sequence opt3 from VP1__Norovirus_and/or_Norovirus-like__FJ411170
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaagauguguucaccgucagcugcagaguucugacaaggccgaguccugacuuugauuucauuuuucucgugcccccaaccguagagucccggacuaaaccuuucacagugcccaucuuaaccgucgaagagaugacuaauucucgcuuuccaauaccccuggagaaacuuuucacgggaccuagcggugcguucgugguucagccacagaacggcagauguaccacagacgggguguugcugggaacuacccaacuauccccggucaauauuugcacauuuaggggcgaugugacccauaucgccgguacgcacgacuacacuaugaaccucgcaucacagaauuggaacaauuaugaucccacagaagagauuccugcuccacuggggacccccgacuucguaggaaagauccagggcguucuuacucagacaacccggggcgacgggaguacgcgcggacauaaggccaccgugagcacagguucuguccacuuuacuccuaagcugggcuccgugcaauucaccacagauacuaacaaugacuuugaaaccgggcagaacacaaaauucaccccagucggagugguucaggauggcaauucaacucaccaaaacgagccccagcaguggguguugccgaauuacagcggucgaacggggcauaacguacaccucgcuccugccgucgcaccaacauuucccggcgaacagcuguuauucuuuagaaguaccaugccuggauguucuggcuaccccaauaugaaccuggacugccuccuuccacaagagugggugcagcauuucuaucaggaggccgcuccugcgcaguccgauguugcacuguugagguuugugaaccccgacacugggcggguccuauucgaauguaagcugcacaaaagcggauacgugaccguagcccacacaggucaacaugaucucgugaucccaccgaauggcuauuuucguuucgacucguggguuaaccaguucuacacccuggcuccuauggggaauggagccggccgcagaagguga

SEQ ID NO: 20443 - RNA, 1617 nt, Artificial Sequence
  derived and/or modified sequence opt3 from VP1__Norovirus_and/or_Norovirus-like__EU839589
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcggugccuucgugguucagccucagaauggcagauguacuaccgaugggguguugcugggaacaacucaacuauccccagucaacauuugcaccuuuaggggcgacgugacacauaucgcagguucacgggauuacaccaugaaucucgcuagucugaacuggaauaacuaugacccgacggaggaaauucccgccccucuugggacuccagacuucguaggaaagauccagggcguucugacacagaccacuaagggcgaugggagcacacgcggacacaaggcuaccguguacacggguucugcccccuuuaccccuaaauugggcuccguccaguuccgaacagacacugagaaugauuuugaaacccaucaaaacacaaaguucacuccagugggggucauccaggacggaucaaccacacacagaaaugagccccagcaaugggugcucccgagcuacaguggcaggaacguucacaaugugcaucuggccccugcaguagcuccaaccuuucccggugaacaguuacuguucuuucggucuacuaugccuggguguuccggcuaucccaacauggaucucgacugccuucugccacaggaguggguccagcacuucuaccaagaggcggccccugcacagagcgauguggcuuugcuacguuuuguuaaucccgacacgggacgcgugcuguucgaauguaaacuccauaagucgggcuaugucacaguggcccacaccgggcagcacgaucugguaauuccaccgaacggauacuuuagauucgacucuugggugaaccaguucuauacucuugcaccuauggguaauggcaccgggaggcggcgauga

SEQ ID NO: 20444 - RNA, 1617 nt, Artificial Sequence
  derived and/or modified sequence opt3 from VP1__Norovirus_and/or_Norovirus-like__KX353961
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucaacuuucgugguucagccacagaacgguagauguaccacagauggcguguugcuggggacuacccaacuaaguccggucaauauuugcacauuuaggggagacgugacccauaucgcgggcagccggaacuacacgaugaaucucgccucucagaacuggaacuccuaugaucccacugaggaaauuccugcaccacuggguacacccgacuucguagggaagauccagggaguucuuacccagacuacacgcaccgacggcucaacgcgaggccacaaggcuaccguguacacagggagcgccgauuuuaguccuaagcugggaagaguccaauucgcuacugacaccgauaaugacuuugaugccaaucagaacacaaaauucacuccagugggugucauccaggacggcgauaccgcacauaggaaugagccccaacaguggguguugccgucuuacuccgggcggaacacacacaauguucaccucgccccugcuguggcgccaaccuuucccggagaacagcuguuauucuuucguagcacuaugccuggcuguucggguuaucccaacauggaccuggauugccuccuuccacaggaguggguacaauacuucuaucaggaagcagccccugcucagucugacgucgcccuguugcgcuuugugaaucccgauacggggagaguucuauucgaguguaagcugcauaaauccggcuacgugacagucgcacacaccggacagcaugaccucgugauuccaccgaacggcuauuuuagguucgacucauggguaaaccaauucuacacucuggccccuauggggaauggaaccggucggcgacgcuga

SEQ ID NO: 20445 - RNA, 1617 nt, Artificial Sequence
  derived and/or modified sequence opt3 from VP1__Norovirus_and/or_Norovirus-like__AB933757
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucucugcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaacgccccuggagaaacuuuucacuggaccuucaaguaccuucgugguucagccacagaacgguagauguacaacugauggcguguugcuggggaccacacaacuaagcccggucaauauaugcaccuuuaggggagacgugacgcauauuacuggcucucacaacuacacaaugaaucucgccucccagaacuggaacucauaugaucccaccgaggaaaucccugcgccacuggguacucccgacuucguagggaagauucagggaguucuuacacagaccacgcggaccgacggcagcacacgcggccauaaggccacuguguacaccgggagugcagaguuuucuccuaagcugggacgaguccaaguggcuacagauacuaauaaugacuucgaugccaaccagaauaccaaauuuacaccagucggugugauccaggacggcgggaccacucacagaaacgaaccccaacaguggguuuugccguccuacagcggaaggaaugcucacaacgugcaucucgccccugcaguagccccaacguuccccggcgagcagcuguuauuuuuccggucgacaaugccugguuguucuggguaucccaauauggaucuggacugccuccuuccacaggaauggguccaacacuuuuaccaggaggcugcgccugcacaguccgauguggcccuguugcguuucguuaaccccgacaccggccgcgugcuauuugaguguaagcugcauaaaucaggauaugucacuguggcucacaccggccagcacgaucucguaaucccaccgaacggguacuucagauuugacaguugggugaaucaauucuauacacuggccccuaugggaaacgguaccggcaggcggcgauga

SEQ ID NO: 20446 - RNA, 1617 nt, Artificial Sequence
  derived and/or modified sequence opt3 from VP1__Norovirus_and/or_Norovirus-like__KM245074
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucgcaacagacacugagaacgauuuugaaacccaucaaaauacaaaguucacuccugugggcgucauccaggacgggagcaccacacaccgaaacgagccacagcaaugggugcuccccaguuacucuggaagaaauguucacaacgugcaucuggccccggcuguagcgccuaauuuuccaggcgaacaguuacuguucuuuagguccaccaugcccgguuguagcggguauccuaacauggaucucgacugccuucugccccaggaguggguccagcacuucuaccaagaggcagccccagcucagucggauguggccuugcuacgguuuguuaacccugacacuggccgugugcuguucgaauguaaacuccauaagucuggauaugucacgguggcacacacaggccagcacgaucugguaauucccccaaauggguacuuucgcuucgacuccugggugaaccaguucuauacccuugccccgaugggaaaugguacuggcagaaggcgguga

SEQ ID NO: 20447 - RNA, 1617 nt, Artificial Sequence
  derived and/or modified sequence opt3 from VP1__Norovirus_and/or_Norovirus-like__EU921368
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccugucccggauguauaauggcuacgcugguggguucgaagugcaggucauucuagccggaaacgcguuuacggcaggcaaaaucauuuucgccgcugugccuccaaauuuuccgaccgagggccucucucccucgcagguaacaauguucccucauaucauaguugacgugcgccaacuggagccaguccuuaucccccugccugaugugcgaaacaauuuuuaucacuacaaccagucaaaugacccaacuauuaaguugaucgccaugcucuauacaccccugcgugcaaacaacgcuggggaugacguguucaccgucagcugcagaguucugaccaggccgaguccugauuuugacuucauuuuucucgugcccccaacuguagaaucccggacaaaaccuuucucugugcccaucuuaaccgucgaggaaaugacgaauagccgcuuuccaauaccccuggagaaacuuuucacuggaccuuccucagccuucgugguucagccacagaacgguagauguaccacagauggcguguugcuggggacuacccaacuaaguccggucaauauuugcacauuuaggggaaacgugaccaauaucgcgggcagccagacguacacuaugaaccucgccucucagaauuggaacaauuaugaccccacagaggaaauuccugcaccacuggguacccccgauuucguagggaagauccagggaguucuuacucaaacaaccaagggcgacggcuccacgcgggggcauaaggcuaccgugucaacaggaagcgcccaguuuacuccuaaacuggguaguguccaguucucuaccgacacauccacugauuuugagaccggccaaaacacacgcuucaccccagugggggucauccaggacggaagcacuacgcacaagaaugaaccccagcaguggguguugccgucguacucuggccgagauucccauaacguucaccucgcuccugccguggcaccaacauuucccggugagcaaauucuguucuuuagaucaaccaugccuggguguaguggcuaccccaauauggacuuagauugccugcucccacaggaauggguacagcacuucuaucaggagagcgccccugcucaauccgacgucgcgcuucugagguuugugaaccccgauacuggacggguuuuguucgaguguaaacuacauaagucuggcuacgugaccgucgcacacacagggcagcaugaccuggugauaccaccgaauggauauuuucguuucgauagcuggguaaaccaguucuacacccucgccccuauggguaacggcgcugggcgcagaagguga

SEQ ID NO: 20448 - RNA, 1617 nt, Artificial Sequence
  derived and/or modified sequence opt3 from VP1__Norovirus_and/or_Norovirus-like__EU921338
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggggcgacggcagcacgcgcgggcacaaggccaccgugucuacaggauccguccauuuuacuccuaagcuggguucagugcaguucagcaccgauacaaguaaugacuuugagacuggccagaacacccgauucacaccagucggggugguucaagauggaucuaccacucaccagaaugaaccccagcaguggguguugccggcuuacuccggcagagacaaccacaauguacaucucgccccugcagucgccccaacguuucccggugagcaacuguuauucuuuaggagcacaaugccuggguguucgggcuaccccaacaugaaucuggauugccuccuuccacaggaaugggugcagcacuucuaucaggagucugcuccugcgcaauccgacguugcacuguugcgguuugugaaccccgauaccggacguguccuauucgaguguaaacugcauaagucaggcuacgugacuguagcccacaccgggcagcacgaccucgugaucccaccgaacggauauuuucgcuucgauaguuggguuaaucaguucuacacacuggcuccuauggguaacggcgccgggagaaggcgguga

SEQ ID NO: 20449 - RNA, 1617 nt, Artificial Sequence
  derived and/or modified sequence opt3 from VP1__Norovirus_and/or_Norovirus-like__LC005708
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguucagaaugugcaccuggccccugcaguagcuccaaccuuucccggugagcaguuacuguucuuuaggagcacuaugccuggguguucgggcuaucccaacauggaucucgacugccuucugccacaggaguggguccaacauuucuaccaggaagcggccccugcacagucugauguggcuuugcuacgguuuguuaaucccgacacgggacgugugcuguucgaguguaaacuccacaaguccggcuaugucacaguggcccauaccgggcagcacgaucugguaauuccaccgaacggauacuuucgcuucgacucaugggugaaccaauucuauacucuugcaccuauggguaauggcaccgggagaaggcgguga

SEQ ID NO: 20450 - RNA, 1617 nt, Artificial Sequence
  derived and/or modified sequence opt3 from VP1__Norovirus_and/or_Norovirus-like__LC005704
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguucugcccccuuuacaccuaaauugggcuccguccaguucucaacugacaccgaaaacgauuuugagacacaucagaauacuaaguucaccccagugggggucauccaagacggaagcacaacccaccgaaacgaaccccagcagugggugcucccgaguuacucuggcagaaauguucacaacgugcaucuggccccugcaguagcuccaacuuuucccggugagcaauuacuguucuuuagguccacgaugccuggguguagcggcuaucccaauauggaucucgacugccuucugccacaggaguggguccagcacuucuaccaggaagcggccccugcacaaucggauguggcuuugcuacgguuuguuaaccccgacacaggacgugugcuguucgaguguaaacuccauaagucuggcuaugucaccguggcccacacugggcagcacgaucugguaauuccaccgaacggauacuuucgcuucgacuccugggugaaucaguucuauacccuugcaccuauggguaacggcacagggagaaggcgguga

SEQ ID NO: 20451 - RNA, 1617 nt, Artificial Sequence
  derived and/or modified sequence opt3 from VP1__Norovirus_and/or_Norovirus-like__KF429777
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaguaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagagcaacgacaguaccauuaaguugaucgcuaugcucuauacaccacugcgugccaauaacgcgggggaugacguguucacugucuccugcagaguucugaccaggcccucuccggauuuugacuucauuuuucucgugccucccacaguagaaagccggaccaaaccauucacugugccuaucuuaacagucgaggaaaugaccaacucccgcuuucccauaccacuggagaaacuuuucacgggacccucaagugccuucgugguucagccucagaaugguagauguacuaccgauggcguguugcuggggacaacucaacuaagcccagucaacauuugcaccuuuaggggagacgugacacauaucgcaggcucucggaauuacaccaugaaccucgcuucccugaauuggucaaacuaugauccgacggaggaaauucccgccccucuugguacuccagacuucguagggaagauccagggaguucugacacagaccacuaagggcgacggcagcacacgcgggcacaaggcuaccguguacacgggaagugccgauuuuacccccaaauuggguucuguccaguucgcaacagacacugagaaugauuuugaaacccaucaaaacacacgauucacuccugugggcgucauccaggacgggggaaccacacacagaaaugagccacagcaaugggugcuccccuccuacagcggcaggaacguucacaaugugcaucuggccccggcuguagcgccuaacuuuccaggugaacaguuacuguucuuucggucgaccaugcccggguguucuggcuauccuaauauggaucucgacugccuucugccccaggaguggguccagcacuucuaccaagaggcagccccagcucaguccgauguggccuugcuacguuuuguuaacccugacacuggacgcgugcuguucgaauguaagcuccauaaaucaggcuaugucacgguggcacacacagggcagcacgaucugguaauucccccaaauggauacuuuagauucgacaguugggugaaccaguucuauacccuugccccgauggguaacggcacugggaggcggcgauga

SEQ ID NO: 20452 - RNA, 1617 nt, Artificial Sequence
  derived and/or modified sequence opt3 from VP1__Norovirus_and/or_Norovirus-like__JX439840
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggaucccagauuucguaggaaagauccagggcguucugacucagacaaccaagggcgacgggucuacucgcggacacaaggcuacaguguacaccgguuccgcccccuuuacgccuaaauugggcucaguccaguucagcaccgacacagaaaaugauuuugagacucaucaaaacaccaaguucacaccagugggggucauucaggacggaggcacuacccaccgaaaugaaccccagcaaugggugcucccgaguuacucugguagaaacguucagaaugugcaccuggccccugcaguagcuccaacauuucccggggagcaguuacuguucuuuagguccaccaugccuggcuguagcggauaucccaacauggaucucgacugccuucugccacaggaguggguccaacauuucuaccaggaagcggccccugcacagucggauguggcuuugcuacgguuuguuaaucccgacacuggccgugugcuguucgaguguaaacuccacaagucuggguaugucacgguggcccauacaggacagcacgaucugguaauaccaccgaacgguuacuuucgcuucgacuccugggugaaccaauucuauacccuugcaccuaugggcaaugggacuggaagaaggcgguga

SEQ ID NO: 20453 - RNA, 1617 nt, Artificial Sequence
  derived and/or modified sequence opt3 from VP1__Norovirus_and/or_Norovirus-like__JX644026
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaaugcacagaacguucaccuggccccugcuguggcgccaaccuuucccggcgagcaguuacuguucuuuaggagcacuaugccugguuguucgggguaucccaauauggaucucgacugccuucugccacaggaguggguacaacauuucuaccaggaagcagccccugcucagucugaugucgccuugcuacgguuugugaaccccgacacgggccguguucuguucgaguguaaacuccacaaguccggauaugugacagucgcacauaccggccagcacgaucuggugauuccaccgaacggguacuuucgcuucgacucauggguaaaucaauucuauacucuugccccuaugggaaacgguaccggcagaaggcgguga

SEQ ID NO: 20454 - RNA, 1617 nt, Artificial Sequence
  derived and/or modified sequence opt3 from VP1__Norovirus_and/or_Norovirus-like__JX459906
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucggcacagacacugaaaacgauuuugagacccaucaaaauacaaaguucacuccagugggggucauccaggacggaggcaccacacaccgaaacgaaccccagcaaugggugcucccgagcuacagugguagagauguuccuaaugugcaccuggcaccagccguagcucccaccuuuccuggggagcaguuacuguucuuuaggucuacuaugcccggcuguuccggauauccaaacauggaccucgauugccuucugccucaggaguggguccagcauuucuaccaagaagcggcacccgcccagagcgacguggcuuugcuacgguuuguuaauccagauacgggccgugugcuguucgaguguaaacuccacaagucgggguaugucacaguggcccauaccggacagcacgaccugguaauuccgccuaacgguuacuuucgcuucgauucuugggugaaccaguucuauacucuugcacccaugggcaaugggaccggaagaaggcgguga

SEQ ID NO: 20455 - RNA, 1617 nt, Artificial Sequence
  derived and/or modified sequence opt3 from VP1__Norovirus_and/or_Norovirus-like__JX459597
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuugccacgccccucugggaccagauuugaaccccuacuuaagucaucuggcucggauguauaauggcuacgccgguggguucgaagugcaggucauucuagcgggaaacgcauuuacggccggcaaaaucauuuucgcugccgugccuccaaauuuuccgaccgagggccucagccccucccagguaacaauguucccucacaucauaguugacgugcgccaacuggagccaguccuuaucccccugccugaugugcgaaacaauuuuuaucauuacaaccagucuaaugacccaacuauuaaguugaucgcaaugcucuauacgccccugcgugcuaacaacgccggggaugacguguucacagucucguguagaguucugaccaggccgucaccugauuuugacuucauuuuucucgugcccccaacuguagaaagccggacaaaaccuuucagugugcccaucuuaaccgucgaggaaaugaccaauucccgcuuuccaauaccccuggagaaacuuuucacuggaccuucuagcgcguucgugguucagccacagaacgguagaugcaccacagauggcguguugcuggggacuacccaacuauccccggucaauauuuguacauuuaggggagacgugacccacaucgccggcacgcagaacuacacuaugaaucucgcaucacagaacuggaauaacuaugaucccacagaggaaauuccugcuccacuggguacccccgacuucguagggcggauccagggaguucuuacucaaacaacccgccgagacggcaguacgagaggccauaaggccacccugagcacagggucugugcacuuuacuccuaaguugggauccguccaguucucaaccgauacaagcaaugacuuugagacuggucagaacaccagguucacaccagugggcgucgugcaagaugggaguaccacucaccagaaugaaccccagcaguggguucucccgaacuacucuggacgggacucccauaaugugcaccuggcuccugccguagcaccaacguuucccggcgagcaauuacuguucuuucguagcacaaugccugguugcucgggguaccccaacaugaaucucgauugucuucugccacaggaauggguccagcauuucuaucaggagucugccccugcucaauccgacguggcguugcuacgcuuuguuaaccccgauaccggcagagugcuguucgagugcaagcuccacaaaucaggauacgucacuguggcacacaccggccagcaugaccugguaaucccaccgaacggguauuuuagguucgauaguugggugaaucaguucuacacacuugccccuaugggaaacggugcuggccggcgacgcuga

SEQ ID NO: 20456 - RNA, 1617 nt, Artificial Sequence
  derived and/or modified sequence opt3 from VP1__Norovirus_and/or_Norovirus-like__HQ456334
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgacuuuacccccaaauuggguuccguccaguucaauacagauacugaaaacgacuuugagacccaucaaaauacaaaguucacuccugugggcgucauccaggaugggucaaccacacaccgaaacgaaccacagcaaugggugcuccccagcuacaguggaagaaauguucacaacgugcaucuggcuccggcgguagcaccuaccuuuccaggcgagcaguuacuguucuuuaggucuacuaugcccgguuguuccggguauccuaauauggaccucgauugccuucugccccaggaguggguccagcacuucuaccaagaagccgcuccagcccagagcgacguggcauugcuacgguuuguuaacccugauacgggccgugugcuguucgaguguaaacuccauaagucgggauaugucacaguggcccacaccggccagcacgaccugguaauucccccaaacggguacuuucgcuucgauucuugggugaaucaguucuauacucuugcuccgaugggaaacgguaccggcagaaggcgguga

SEQ ID NO: 20457 - RNA, 1617 nt, Artificial Sequence
  derived and/or modified sequence opt3 from VP1__Norovirus_and/or_Norovirus-like__HM802553
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcagguccuacucgcaggaaacgccuuuacagcuggcaaaauuaucuucgccgcagugccuccaacuuuuccgacggagggccugucucccucgcagguaaccauguucccucauauuaucguugacgugcgccaacuugagccaguccugauacccuugccugaugugcgaaauaacuuuuaucacuacaaucagucaaacgacagcacaaucaagcucguggcuaugcuguauacuccacugcgugccaauaacgcgggggaugacgucuucaccguuaguugcagagugcucacaaggcccuccccggauuuugacuucaucuuuuuaguaccucccaccguggaaucucggacuaaaccauucacagucccuauucugaccguggaggaaaugacgaacagccgcuuucccauuccacuugagagauuguucacuggacccuccucagccuucguugugcagccucagaaugguagguguaccacagauggcguccugcuagggacuacccaacucaguccagugaacaucugcacauuucggggagacguaaccaauauaccgggcagccgcacguaccgaaugaaccuggcaucucagaauuggaacaauuaugaucccacugaggaaauuccugcuccacuugguacacccgacuucguugggaagauccagggagugcugacccagacuacaaaaggcgacggcuccaccagagggcauaaggccacggucaggaccggaucagcugauuuuacaccuaaguuggguagcgugcaauucgccacugacaccgauaacgacuuugucacaggccagaauacucgguucaccccaguggggguuauucacgauggaaguucugcacaucguaacgagccccagcaaugggugcucccggaauacuccggccgcagcguacacaauguccaccuggccccugcuguggcgccaacauuucccggugagcaguuacuguucuuuagaucgaccaugccuggguguucuggcuaccccaacauggaccucgauugccuucugccacaggaauggguucagcauuucuaucaagaggcagccccuucccagucagacguggcuuugcuaagguuugucaaucccgauacuggacgggugcuguucgaguguaaacuccacaaggccggcuacguaacgguggcacauacagggcagcacgaccugguuaucccaccgaacggauauuuucgauucgauaguugggucaaucaguucuacacccuugccccuauggguaacggcgcugggcgcagaagguga

SEQ ID NO: 20458 - RNA, 1617 nt, Artificial Sequence
  derived and/or modified sequence opt3 from VP1__Norovirus_and/or_Norovirus-like__HQ008055
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccaguugaaugacccaacaauuaagcucaucgcaaugcuguauacuccccugcgugcuaacaacgccggggaugacguguucaccgucucaugcagaguucucacaaggccgagcccugauuuugacuucaucuuuuuagugcccccaaccguagaaagucggacuaaaccuuucuccgugcccauucugacagucgaggaaaugaccaauucucgcuuuccaauaccccuugagaaguuguucacgggaccuagcuccgcguucgugguucagccacagaacgguagauguacuaccgauggcgugcugcuagggacaacucaacucucaccggucaauauuugcaccuuuaggggagacgugacacauaucaccggcagucacaacuacacgaugaaucuggccagccagaacuggaacucuuaugaucccacugaggaaauuccugcaccacuugguacacccgacuucguagggaaaauccagggaguucugacccagacuacacgggcugacggcuccacccgcggccaucgagccacgguguacaccgggucagcugaguuugccccuaaguugggaagaguccaauucgcaacagauacugaaaaugacuuugauaccaaucagaacacaaaguucacuccagugggugucauccaggacggcaauaccacacacaggaacgagccccaacagugggugcucccgagcuacagugggcguaauucucacaacguucaucuggccccugcuguggcgccaaccuuucccggagaacaguuacuguucuuucgguccacuaugccuggcuguagcgguuaucccaaucucgaucuugacugccuguugccacaggaguggguacaacacuucuaccaggaggcagccccugcucagucggaugucgcccuacugcgcuuugugaaccccgacacggggagaguucucuucgaauguaaacugcauaagucuggcuaugugacagucgcacacaccggacagcacgaucuugugauuccaccgaacggcuacuuuagguucgacuccuggguaaaucaauucuauacucuggccccuauggggaacggaaccggucggcgacgcuga

SEQ ID NO: 20459 - RNA, 1617 nt, Artificial Sequence
  derived and/or modified sequence opt3 from VP1__Norovirus_and/or_Norovirus-like__AB541360
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagauccaucaaaauaccaaguucacaccagugggcgucauucaggacgggaguacuacccaccgaaacgaaccccagcaaugggugcucccgucuuacuccggaagaaauguucacaacgugcaucuggccccugcaguagcuccaacauuucccggcgagcaguuacuguucuuuaggagcaccaugccugguuguucgggguaucccaauauggaucucgacugccuucugccacaggaguggguccagcacuucuaccaagaagcggccccugcacagucugauguggcuuugcuacgguuuguuaaccccgacacuggccgugugcuguucgaguguaaacuccauaaguccggauaugucacgguggccuacacaggccagcacgaucugguaauaccaccgaacggguauuuucgcuucgacucaugggugaaucaguucuacacccuugcaccuaugggaaacgguacuggcagaaggcgguga

SEQ ID NO: 20460 - RNA, 1617 nt, Artificial Sequence
  derived and/or modified sequence opt3 from VP1__Norovirus_and/or_Norovirus-like__AB541262
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauguagcaggcagucggaauuacaucaugaaccucgcuagccugaauuggaacaauuaugacccgaccgaagagauucccgccccucuugguacgccagauuucguugggaagauccagggagugcugacucagacaaccaagggcgacggcucuacucgcgggcacaaggcuacagucuacaccggauccgcccccuuuacgccuaaauuggguucagugcaguucagcaccgacacagaaaacgauuuugagacucaucaaaauaccaaguucacaccagucggcgugauccaggacgggaguacuacccaccgaaacgaaccccagcaauggguucucccgucuuacuccggaagaaaugugcacaacguacaucuggccccugcagucgcuccaacauuucccggcgagcaguuacuguucuuuaggagcaccaugccugguuguucgggguaucccaauauggaucucgacugccuucugccacaggagugggugcagcacuucuaccaagaagcggccccugcacagucugauguugcuuugcuacgguuugugaaccccgacacuggccguguccuguucgaguguaaacuccauaaguccggauaugugacgguagcccacacaggccagcacgaucuggugauuccaccgaacggguacuuucgcuucgacucauggguuaaucaguucuauacccuugcaccuaugggaaacgguacuggcagaaggcgguga

SEQ ID NO: 20461 - RNA, 1617 nt, Artificial Sequence
  derived and/or modified sequence opt3 from VP1__Norovirus_and/or_Norovirus-like__AB541231
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgcagugcagccucagaaugguagauguacuaccgacggcguuuugcuggggacaacucaacuaucaccagugaacauuugcaccuuuaggggagaugucacacauaucgcuggcagucggaauuacaccaugaaccucgccagccugaauuggaacaauuaugacccgacggaagagauucccgcuccucuugguacuccagauuucguggggaagauccagggaguacugacacagaccacuaagggcgacggcucuacacgcgggcacaaggccaccguuuacacgggauccgcacccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagaaaugugccuaacguucaccuggccccagcuguggcgcccaccuuuccuggcgagcaguuacuguucuuuaggagcacuaugcccgguuguucgggguauccaaauauggaucucgacugccuucugccucaggaguggguacagcauuucuaccaagaagcagcccccgcucagucugaugucgccuugcuacgguuugugaacccagacacgggccguguucuguucgaguguaaacuccacaaguccggauaugugacagucgcacauaccggccagcacgaucuggugauuccgccuaacggguacuuucgcuucgacucauggguaaaucaguucuauacucuugcccccaugggaaacgguaccggcagaaggcgguga

SEQ ID NO: 20462 - RNA, 1617 nt, Artificial Sequence
  derived and/or modified sequence opt3 from VP1__Norovirus_and/or_Norovirus-like__GQ246792
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuuacuccuaagcugggaagaguccaauucgccaccgacacagauaaugacuuugaugcaaaucagaacacuaaauucaccccagugggugucauccaggacggcaauacagcccauaggaacgagccccaacaguggguguugccgagcuacagugggcguaauucucacaacguucaccucgcuccugcgguggcaccaaccuuucccggagaacagcuguuauucuuucgguccacuaugccuggcuguagcgguuaucccaauauggaucuggacugccuccuuccacaggaguggguacaauacuucuaucaggaagccgcuccugcccagucggaugucgcacuguugcgcuuugugaaccccgacacggggagaguucuauucgaguguaagcugcauaaaucuggcuacgugacagucgcccacaccggacagcaugaucucgugauuccaccgaacggcuauuuuagguucgacuccuggguaaaucaauucuacacucuggcuccuauggggaacggaaccggucggcgacgcuga

SEQ ID NO: 20463 - RNA, 1617 nt, Artificial Sequence
  derived and/or modified sequence opt3 from VP1__Norovirus_and/or_Norovirus-like__AB504329
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguucugcccccuuuacaccuaaauugggcuccguccaguucucaacugacaccgaaaacgauuuugagacacaucagaauacuaaguucaccccagugggggucauccaagacggaggcacaacccaccgaaacgaaccccagcagugggugcucccgagcuacagugguagaaauguucacaacgugcaucuggccccugcaguagcuccaacuuuucccggggagcaauuacuguucuuuaggucuacgaugccuggcuguuccggauaucccaauauggaucucgacugccuucugccacaggaguggguccagcacuucuaccaggaagcggccccugcacaaagcgauguggcuuugcuacgguuuguuaaccccgacacaggccgugugcuguucgaguguaaacuccauaagucgggguaugucaccguggcccacacuggacagcacgaucugguaauuccaccgaacgguuacuuucgcuucgacucuugggugaaucaguucuauacccuugcaccuaugggcaacgggacaggaagaaggcgguga

SEQ ID NO: 20464 - RNA, 1617 nt, Artificial Sequence
  derived and/or modified sequence opt3 from VP1__Norovirus_and/or_Norovirus-like__AB504306
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaagagccgcuuucccauaccacuggagaaacuuuacacgggacccuccucagcguucgugguucagccucagaacgguagauguacuaccgauggcguguugcuggggacaacucaacuaagugucgugaauauuugcaccuucaggggagacguaacacauaucgccggcagccacgauuauaccaugaaccucgcaucucagaauuggaacaauuacgacccaacggaggaaauuccggcuccccuggguacuccugacuuuguugggaagauccagggaaugcuuacacagaccacucgggaggauggcuccacacgcgcccauaaggcuaccgugucaacgggcagcguccacuucaccccaaaacuggggagugugcaauacacaacugacaccaacaaugauuuucagacaggacagaacacuaaguucacccccgucggugugauccaagacggcaauaaccaccagaaugaaccucagcaguggguuuugccaaacuauucugggcgaacaggacauaaugugcaccucgcccccgcaguagccccgaccuuuccuggcgagcaacuguuauucuuuagauccacuaugccagguuguagcggguaccccaacaugaaccuggauugccuccuuccucaggaauggguccagcauuucuaucaggaggcugcgcccgcacaaucggacguggcccuguugagguuuguuaauccagauacgggccgguuccuauuugaguguaaacugcacaagucuggauacgugacagucgcucacaccggcccucaugaccucgugauucccccaaacggguauuuccguuuugauuccuggguaaaucaguucuacacucuggccccgaugggaaacggugcaggccgcagaaggguguga

SEQ ID NO: 20465 - RNA, 1617 nt, Artificial Sequence
  derived and/or modified sequence opt3 from VP1__Norovirus_and/or_Norovirus-like__GQ303445
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgaucaugacuuugaugccaaucagaauacaaaauucacuccagugggugucauccaggacggcgauaccgcucacaggaacgagccccaacaguggguguugccgagcuacagugggcguaauucucacaacguucaucucgcgccugcaguggccccaacauuucccggagaacagcuguuauucuuucgguccaccaugccuggcuguagcgguuaucccaauauggaccuggauugccuccuuccacaggaguggguacaauacuucuaucaggaagcugccccugcacagucggacgucgcccuguugcgcuuugugaaccccgauacugggagaguucuauucgaguguaagcugcacaaaucuggcuacgugacggucgcucauacaggacagcacgaccucgugauuccaccgaauggcuauuuuagguucgacuccuggguaaaccaauucuacacccuggccccuauggggaacggaacuggucggcgacgcuga

SEQ ID NO: 20466 - RNA, 1617 nt, Artificial Sequence
  derived and/or modified sequence opt3 from VP1__Norovirus_and/or_Norovirus-like__EU839588
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuagccgucgaagagaugacaaacucucgcuuucccauaccacuggagaaacuuuucaccggacccagcuccgcauuggugguucagccucagaaugguagauguacgacugacggcgugcugcuagggaccacacaacucucaccagucaacauuugcacuuucaggggagaugugacccauaucgcuggcagucggaauuacacaaugaaccuggccagccuuaauuggaacaauuaugacccgaccgaagagauucccgcuccucuggguacgccagauuuuguagggaagauccagggaguuuugacucagacaaccaagggcgacggcucuacucgcgggcacaaggccacaguguacaccggauccgcacccuucacgccuaaacucgguucaguccaguuuggcaccgacacagaaaacgauuucgagacucaucaaaauaccaaguuuacaccagugggggucauccaggacggaagcacuacccaccgaaacgaaccccagcaaugggugcugccgaguuacucuggcagaaauguucacaacgugcauuuagccccugcuguagcgccaacauuccccggugagcagcugcucuuuuucagguccaccaugccuggguguagcggcuaucccaauauggaucuugacugccuguugccacaggaguggguccagcacuuuuaccaagaagcagccccugcucagucggauguggcccuacugcgguucguuaaccccgacacuggacgugugcucuuugaguguaaacugcauaagucuggcuaugucacgguggcacacacagggcagcacgaucuuguaauuccaccgaacggauacuuccgcuuugacuccugggugaaucaguucuauacccuggccccuauggguaacggcacugggagaaggcgguga

SEQ ID NO: 20467 - RNA, 1617 nt, Artificial Sequence
  derived and/or modified sequence opt3 from VP1__Norovirus_and/or_Norovirus-like__DQ364459
augaagauggccagcaacgacgcuuccucuucagauggcaguaccgcaaaucuggugcccgaggucaacaaugaaguuauggcccucgagccugugguaggggcggcuaucgccgcaccaguggccggacagcaaaacgucaucgacccguggauaagaaauaacuucgugcaggcucccgguggcgaauuuacaguuagcccuaggaaugcaccaggggagauccuuugguccgcuccccugggaccugauuugaacccauacuuaucucaccuggcccggauguauaauggcuacgccgguggguucgaagugcaggucauucuagcgggaaacgcauuuacugccggcaaaaucauuuucgcugccgugcccccuaauuuuccaacggagggccucucgccgucacagguaaccauguucccccauaucauaguugacgugcgccaacuggagccuguccuuaucccacugcccgaugugcgaaacaauuuuuaucacuacaaccagagcaaugacccuacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucgccggcacgcacgauuacacuaugaaccucgcaagccagaauuggaacaauuaugacccgacagaggaaauucccgcuccucuggguaccccagacuucguagggaagauccagggaguucuuacucagacaacccggggcgauggcucuacgcgcgggcauaaggccaccguguccacaggaucaguccacuuuacucccaagcuggguagcgugcaauucaccacagacacuaacaaugauuuugagaccggccagaacacaaaauucaccccugucggggugguucaggacggaaauaguacucaccaaaacgaaccacagcaguggguguugcccaauuacucuggccgaacgggucauaacguacaccucgcuccggccgucgcaccuacauuuccaggggagcagcuguuauucuuuagauccaccaugcccggcuguagcggauacccuaauaugaaccuggauugccuccuuccccaagaaugggugcagcauuucuaucaggaggccgcuccagcgcagucggacguugcacuguugagguuugugaacccugauacuggccggguccuauucgaguguaagcugcacaaaucuggguacgugaccguagcccacacaggacaacaugaccucgugauucccccaaaugguuauuuucguuucgauuccuggguuaaccaguucuacacccuggcuccgaugggcaauggggccggacgcagaagguga

SEQ ID NO: 20468 - RNA, 1617 nt, Artificial Sequence
  derived and/or modified sequence opt3 from VP1__Norovirus_and/or_Norovirus-like__KY628449
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucuguccccagauuugaaccccuacuuaucucaccuggcccggauguauaauggauacgcgggcgguuucgaagugcaggucauucuagcagggaacgccuuuacagcuggaaaagugaucuucgccgcaguaccuccaaauuuuccgacugagggccucucgcccucacagguuacgauguucccucauauuguggucgacgugcgccaacuggagccagugcuuaucccccugccugauguccgaaacaauuuuuaucacuacaaccagagcaaugacaguaccauaaaguugaucgcuaugcucuauacaccacugcgugccaacaacgcgggcgaugacguuuucacuguguccugcagaguacugaccaggcccucuccggauuuugacuucauuuuucucgugccucccacagucgaaagccggaccaaaccauucuccgugccuguuuuaacuguggaggaaaugacaaauucacgcuuucccaucccacuggagaaacuuuucaccgggcccaguagcgauuucgccguccagccucagaacggaagauguacgacugacgguguguugcugggcaccacacaacuaucuccaguaaauauuugcacuuuuaggggagauguuacccauaucaacggguccucaaauuacaagaugaaccucgcaaaucagaacuggagcaauuaugacccgacagaggaaauacccgcuccucugggcgccccagacuucguggguaagauucaggggguccuuacccagacgacuaaggaggauggaaguacacggggccacaaagcuaccguguacacuggcucugccgacuuugcacccaagcuggggcgcguccaauucgaaacagauaccgaccaugauuuggagaucgaccagaacacgaaauuuaccccugugggaguuauucagaaugguggcacaacucaccgaaacgaaccaaagcaauggaugcuccccuccuacagcgggagaaauaccccgaacgugcaccuggccccugcuguagcgccaacauuccccggagagcaguuacuguuuuucaggucgacuaugccuggcuguucugguuaucccaauauggaucucgacugccuucugccacaggaguggguccagcauuuuuaccaagaagcagccccugcucaguccgauguggccuugcuacgguucguuaaccccgacaccgggcgugugcuguuugaguguaaacuccacaagucaggcuaugucacaguggcacauaguggacagcacgaucugguagugccaccgaacggcuacuuccgcuuugacagcuggguuaaucaguucuauacccuugccccuauggggaacggauccgguagaaggcgguga

SEQ ID NO: 20469 - RNA, 1617 nt, Artificial Sequence
  derived and/or modified sequence opt3 from VP1__Norovirus_and/or_Norovirus-like__KX371608
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucacugugccuaucuuaacagucgaggaaaugaccaauagccgcuuucccauaccacuggagaaacuuuucacgggacccuccucagccuucgugguucagccucagaacgguagauguacuaccgauggcguguugcuggggacaacucaacuaaguccagucaauauuugcaccuuuaggggagacgugacacauaucgcaggcagccacaacuacaccaugaaucucgcuucucugaacuggaauaacuaugauccgacggaggaaauucccgccccucuugguacuccagacuucguagggaagauccagggaguucugacacagaucaccaagggcgacggcuccacucgggggcauaaggcuacaguguacaccggaucagccgauuuuacgcccaaauuggguagcguccaguucgcaaccgacacagagaaugauuuucaaacucaccagaacacccgcuucacaccugugggcgucauucaggacgggggaacuacccaccaaaaugaaccacagcagugggugcuccccaguuacucuggccgaaacguucauaaugugcaccuggccccggcuguagcgccuaacuuuccaggugagcaguuacuguucuuuagauccacaaugcccggguguagcggcuauccuaauauggaucucgacugccuucugccccaagaauggguccagcauuucuaccaggaggcagccccagcucagucggauguggccuugcuaagguuuguuaacccugacaccggacgggugcuguucgaguguaagcuccacaaaucuggcuaugucacuguggcacacacggggcaacaugaucugguaauacccccaaacggauacuuucguuucgacuccugggugaaucaguucuauacacuugccccgauggguaacggcaccgggcgcagaagguga

SEQ ID NO: 20470 - RNA, 1617 nt, Artificial Sequence
  derived and/or modified sequence opt3 from VP1__Norovirus_and/or_Norovirus-like__KX354089
augaagauggccagcaacgacgcuaaucccuccgauggcucugcagccucacuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucacugugccuaucuuaacagucgaggaaaugaccaauagccgcuuucccauaccacuggagaaacuuuucacgggacccuccucagccuucgugguucagccucagaacgguagauguacuaccgauggcguguugcuggggacaacucaacuaaguccagucaauauuugcaccuuuaggggagacgugacacauaucgcaggcagccggaacuacaccaugaaucucgcuucucugaacuggaauaacuaugauccgacggaggaaauucccgccccucuugguacuccagacuucguagggaagauccagggaguucugacacagaccacuaagggcgacggcuccacacgcgggcacaaggcuaccguguacacgggaucagccgauuuuacccccaaauuggguagcguccaguucgcaacagacacugagaaugauuuugaaacccaucaaaacacaaaguucacuccugugggcgucauccaggacgggggaaccacacaccgaaaugagccacagcaaugggugcuccccaguuacucuggcagaaacguucacaaugugcaucuggccccggcuguagcgccuaacuuuccaggugaacaguuacuguucuuuagguccaccaugcccggguguagcggcuauccuaauauggaucucgacugccuucugccccaggaguggguccagcacuucuaccaagaggcagccccagcucagucggauguggccuugcuacgguuuguuaacccugacacuggacgugugcuguucgaauguaaacuccauaagucuggcuaugucacgguggcacacacagggcagcacgaucugguaauucccccaaacggauacuuucgcuucgacuccugggugaaucaguucuauacccuugccccgauggguaacggcacugggagaaggcgguga

SEQ ID NO: 20471 - RNA, 1617 nt, Artificial Sequence
  derived and/or modified sequence opt3 from VP1__Norovirus_and/or_Norovirus-like__KX354001
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucacugugccuaucuuaacagucgaggaaaugaccaauagccgcuuucccauaccacuggagaaacuuuucacgggacccuccucagccuucauugugcagccucagaacgguagauguacuaccgauggcguuuugcuggggacaacucaacuaaguccagugaauaucugcaccuuuaggggagacgucacacauauugcaggcagccggaacuacaccaugaaucucgcuucucugaacuggaauaacuaugauccgacggaggaaauccccgccccucuugguacuccagacuucguggggaagauccagggaguacugacacagaccacuaagggcgacggcuccacacgcgggcacaaggcuaccguuuacacgggaucagccgauuuuacccccaaauuggguagcgugcaguucgcaacagacacugagaaugauuuugaaacccaucaaaacacacgauucacuccugucggcgugauucaggacgggggaaccacacacagaaaugagccacagcaauggguccuccccaguuacucuggcaggaacgugcacaauguucaucuggccccggcuguggcgccuaacuuuccaggugaacaguuacuguucuuucgguccaccaugcccggguguagcggcuauccuaauauggaucucgacugccuucugccccaggaguggguacagcacuucuaccaagaggcagccccagcucagucggaugucgccuugcuacguuuugugaacccugacacuggacgcguucuguucgaauguaagcuccauaaaucuggcuaugugacggucgcacacacagggcagcacgaucuggugauacccccaaacggauacuuuagauucgacuccuggguaaaucaguucuauacccuugccccgauggguaacggcacugggaggcggcgauga

SEQ ID NO: 20472 - RNA, 1617 nt, Artificial Sequence
  derived and/or modified sequence opt3 from VP1__Norovirus_and/or_Norovirus-like__KX353971
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuaccggcagccggaacuacacgaugaaucucgccucucagaacuggaacuccuaugaucccacugaggaaaucccugcaccacuggguacacccgacuucguugggaagauucagggagugcuuacccagacuacacgcaccgacggcucaacgcgaggccacaaggcuaccgucuacacagggagcgccgauuuuaguccuaagcugggaagagugcaauucgcuacugacaccgauaaugacuuugagacaaaucagaacacuaaauucaccccagucggugugauccaggauggcgggacaacccauaggaaugaaccccaacaguggguuuugccgucuuacuccggacggaacacucacaaugugcaccucgccccugcaguagccccaacguuucccggcgagcagcuguuauucuuucguagcacaaugccugguuguucgggguaucccaacauggaccuggauugccuccuuccacaggaauggguccaauacuucuaucaggaggcugcgccugcacagucugacguggcccuguugcgcuuuguuaaucccgauaccggcagagugcuauucgaguguaagcugcauaaauccggauacgucacuguggcucacaccggccagcaugaccucguaaucccaccgaacggguauuuuagguucgauucaugggugaaccaauucuacacacuggccccuaugggaaaugguaccggccggcgacgcuga

SEQ ID NO: 20473 - RNA, 1617 nt, Artificial Sequence
  derived and/or modified sequence opt3 from VP1__Norovirus_and/or_Norovirus-like__KR131766
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugacgaacucucgcuuucccauaccacuggagagacuuuacacuggacccagcuccgcguucgugguucagccucagaaugguagguguaccacagauggcguguugcuggggacuacccaacuaucagccgucaacauuugcacauuccggggagacgugacccauaucgcaggcagucgcaauuauacgaugaaccucgcuagccagaauuggaacaauuacgauccaacugaggaaauuccggcuccccuggguacaccugacuuuguagggaagauccagggaaugcuuacccagacuacacgaucugacggcuccaccagaggccacaaagccacgguucugaccgggucagccgauuucgcaccaaaguugggaagggugcaauuugccacagacacugauaacgacuucgagagcggucagaauaccaaguuuacacccgucggcgugauccaggaugggaguacuacccaucggaacgaaccucaacaguggguccucccaaauuacucuggacguacaggccacaacgugcaccuggcucccgcgguugcaccgaccuauccuggugagcaguuacuguucuuucgcuccacuaugccaggguguagcggcuaccccaauauggaccucgauugccuucugccucaggaaugggugcaacauuucuaucaggaggccgcucccgcccagucggacguagcauugcuaagauuugucaacccagauacgggaagggugcuguucgaguguaaacuccacaagucuggcuacguuacaguggcccauaccgggcagcacgaccuggucauuccucccaacggauauuuucgguucgauuccugggugaaucaauuuuacacucuugcuccaauggguaacggcaccgggcgacgcagauga

SEQ ID NO: 20474 - RNA, 1617 nt, Artificial Sequence
  derived and/or modified sequence opt3 from VP1__Norovirus_and/or_Norovirus-like__AB663685
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccgggccaaaccauucaccgugccuaucuuaacugucgaggaaaugacaaacucucgcuuucccauaccacuggagaaacuuuucaccggacccagcuccgcauucgugguucagccucagaaugguagauguacgacugauggcguguugcuggggaccacacaacuaucaccagucaacauuugcacuuuuaggggagacgugacccauaucgcuggcagucggaauuacacaaugaaccucgccagccugaauuggaacaauuaugauccgaccgaggaaauucccgcuccucuugguacgccagacuucguagggaagauccagggaguucugacucagacaaccaagggcgacggcucuacucgcgggcacaaggccacaguguacaccggauccgcagauuuuacgcccaaauuggguucaguccaguucggcaccgacacagagaacgauuuugaaacucaucaaaauaccaaguucacaccugugggggucauccaggacggaggcacuacccaccgaaacgagccacagcaaugggugcuccccagcuacagugguagaaauguucacaacgugcaucuggccccggcuguagcgccuaauuuuccaggggaacaguuacuguucuuuaggucuacaaugcccggcuguuccggauauccuaacauggaucucgacugccuucugccccaggaguggguccagcacuucuaccaagaggcagccccagcucagagcgauguggccuugcuacgguuuguuaacccugacaccggccgugugcuguucgaauguaaacuccauaagucgggguaugucacuguggcacacacgggacagcacgaucugguaauucccccaaaugguuacuuucgcuucgacucuugggugaaccaguucuauacacuugccccgaugggcaaugggaccggaagaaggcgguga

SEQ ID NO: 20475 - RNA, 1617 nt, Artificial Sequence
  derived and/or modified sequence opt3 from VP1__Norovirus_and/or_Norovirus-like__AB933746
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucguguucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccauuuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauugccggcagccacaacuacaccaugaaucucgcaucucagaacuggaacuccuaugaucccacggaggaaaucccugcuccacuggguacucccgacuucguugggaagauucagggagugcuuacacagaccacucggacagacggcucaacccgcggccauaaggccacggucuacaccgggagcgcugaguuuaguccuaagcugggacgagugcaauucgccacagauacuaauaaugacuuugaugcaaaccagaauaccaaauucacaccagucggugugauccaggacggcgggacuacccacagaaacgaaccccaacaguggguuuugccgucuuacuccggaaggaauacacacaacgugcaucucgccccugcuguagcgccaaccuuucccggcgagcagcuguuauucuuucggagcacuaugccugguuguucgggguaucccaauauggaucuggacugccuccuuccacaggaauggguccaauacuucuaucaggaggcagccccugcucagucugauguggcccuguugcguuuuguuaaccccgacacgggccgcgugcuauucgaguguaagcugcacaaauccggauacgucacaguggcacauaccggccagcacgaucucguaaucccaccgaacggguauuuuagauucgacucaugggugaaucaauucuacacucuggccccuaugggaaacgguaccggcaggcggcgauga

SEQ ID NO: 20476 - RNA, 1617 nt, Artificial Sequence
  derived and/or modified sequence opt3 from VP1__Norovirus_and/or_Norovirus-like__AB933701
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucagucgaacgacucaacgaucaaguugauugcuaugcucuauaccccacugcgugccaacaaugcgggggaagauguguucacagucagcugcagaguucugacuaggcccaguccggacuuugauuucaucuuucucgugccucccaccguagagucccggacaaaaccauucaccgugccuauauuaacugucgaagagaugacaaacucucgcuuucccauuccacuggagaaacuuuucaccggacccagcuccgccuucgugguucagccucagaaugguagauguacgacugacggcguguugcuggggaccacacaacuaucaccagucaacaucugcacuuuuaggggagaugugacccauauugcaggcagucggaauuacacaaugagccucgcuucucugaacuggaauaacuaugacccgaccgaagagauccccgccccucuugguacgccagauuucguagggaagauccagggaguucugacucagacaaccaagggcgacggcuccacucgcgggcacaaggcuacaguguacaccggaucagcccccuuuacgccuaaauuggguagcguccaguucaguaccgacacagaaaaugauuuugagacucaucaaaacaccaaguucacaccagugggcgucauucaggacgggggaacuacccaccgaaaugaaccccagcaaugggugcucccgucuuacuccggcagaaacguuccuaaugugcaccuggcaccagccguagcucccacauuuccuggugagcaguuacuguucuuuaggagcaccaugcccggguguucgggcuauccaaacauggaucucgacugccuucugccucaggaguggguccagcauuucuaccaagaagcggcacccgcccagucugauguggcuuugcuacgguuuguuaauccagacacuggacgugugcuguucgaguguaaacuccacaaguccggcuaugucacgguggcccauacagggcagcacgaucugguaauaccgccuaacggauacuuucgcuucgacucaugggugaaccaguucuauacccuugcacccauggguaauggcacugggagaaggcgguga

SEQ ID NO: 20477 - RNA, 1617 nt, Artificial Sequence
  derived and/or modified sequence opt3 from VP1__Norovirus_and/or_Norovirus-like__AB933686
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucagucgaacgacucaacgaucaaguugauugcuaugcucuauaccccacugcgugccaacaaugcgggggaagauguguucacagucagcugcagaguucugacuaggcccaguccggacuuugauuucaucuuucucgugccucccaccguagagucccggacaaaaccauucaccgugccuauauuaacugucgaagagaugacaaacucucgcuuucccauuccacuggagaaacuuuucaccggacccagcuccgccuucgugguucagccucagaaugguagauguacgacugacggcguguugcuggggaccacacaacuaucaccagucaacaucugcacuuuuaggggagaugugacccauauugcaggcagucggaauuacacaaugaaccucgcuagccugaauuggaacaauuaugacccgaccgaagagauccccgccccucuugguacgccagauuucguagggaagauccagggaguucugacucagacaaccaagggcgacggcucuacucgcgggcacaaggcuacaguguacaccggauccgcccccuuuacgccuaaauuggguucaguccaguucagcaccgacacagaaaacgauuuugagacucaucaaaauaccaaguucacaccagugggcgucauucaggacgggggaacuacccaccgaaacgaaccccagcaaugggugcucccgaguuacucuggcagaaauguuccuaacgugcaccuggcaccagccguagcucccacauuuccuggugagcaguuacuguucuuuagguccaccaugcccggguguagcggcuauccaaauauggaucucgacugccuucugccucaggaguggguccagcauuucuaccaagaagcggcacccgcccagucggauguggcuuugcuacgguuuguuaacccagacacuggacgugugcuguucgaguguaaacuccacaagucuggcuaugucacgguggcccauacagggcagcacgaucugguaauaccgccuaacggauacuuucgcuucgacuccugggugaaucaguucuauacccuugcacccauggguaacggcacugggagaaggcgguga

SEQ ID NO: 20478 - RNA, 1617 nt, Artificial Sequence
  derived and/or modified sequence opt3 from VP1__Norovirus_and/or_Norovirus-like__AB933680
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccgcacaccgaaacgaaccccagcaaugggugcucccgucuuacuccggaagaaauguucagaacgugcaccuggccccugcuguagcgccaacauuucccggcgagcaguuacuguucuuuaggagcaccaugccugguuguucgggguaucccaauauggaucucgacugccuucugccacaggaguggguccaacauuucuaccaggaagcagccccugcucagucugauguggccuugcuacgguuuguuaaccccgacacuggccgugugcuguucgaguguaaacuccacaaguccggauaugucacgguggcacauacaggccagcacgaucugguaauuccaccgaacggguacuuucgcuucgacucaugggugaaucaauucuauacccuugccccuaugggaaacgguacuggcagaaggcgguga

SEQ ID NO: 20479 - RNA, 1617 nt, Artificial Sequence
  derived and/or modified sequence opt3 from VP1__Norovirus_and/or_Norovirus-like__AB933672
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucacaauuacaccaugaaccucgcuagccugaauuggaacaauuaugacccgacggaagagauucccgccccucuugguacuccagauuucguagggaagauccagggaguucugacacagaccacuaagggcgacggcucuacacgggggcauaaggcuaccguguacacgggauccgcccccuuuaccccuaaauuggguucaguccaguucagcacagacacugaaaacgauuuugagacccaccaaaauacaaaguucacuccagugggcgucauccaggacgggggaaccgcacaccgcaacgaaccccagcaaugggugcucccgaguuacucuggccgaaauguucagaacgugcaucuggccccugcuguagcgccaacauuucccggugagcaguuacuguucuuuagauccaccaugccuggguguagcggcuaucccaauauggaucucgacugccuucugccacaggaguggguccaacacuucuaccaggaagcagccccugcucagucggauguggccuugcuaagguuuguuaaccccgacacuggacgggugcuguucgaguguaaacuccauaagucuggcuaugucacgguggcacacacagggcagcacgaucugguaauuccaccgaacggauacuuucguuucgacuccugggugaaucaauucuauacccuugccccuauggguaacggcacugggcgcagaagguga

SEQ ID NO: 20480 - RNA, 1617 nt, Artificial Sequence
  derived and/or modified sequence opt3 from VP1__Norovirus_and/or_Norovirus-like__AB933664
augaagauggccagcaacgacgcuacccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcuccgccuucgugguucagccucagaacgguagauguaccacagacggcguguugcuggggacuacccaacuaucaccagucaauauuugcacauuuaggggagaugugacccauaucgcaggcagucggaacuacacgaugaaucucgcuagccugaacuggaauaacuaugacccgacugaagagauucccgccccucuugguacaccagauuucguagggaagauccagggaguucugacccagacuacaaagggcgacggcucuacccgcgggcacaaggcuacgguguacaccggauccgcccccuuuacaccuaaauuggguucaguccaguucaauacugacaccgaaaacgauuuugagacacaucaaaauacuaaguucaccccagugggcgucauccaggacgggagcacaacccaccgaaacgaaccccagcaaugggugcucccgaguuacucuggaagaaauguuccuaacgugcaccuggcaccagccguagcucccacuuuuccuggcgagcaguuacuguucuuuagguccacgaugcccgguuguagcggguauccaaauauggaucucgacugccuucugccucaggaguggguccagcauuucuaccaagaagcggcacccgcccagucggauguggcuuugcuacgguuuguuaacccagacacaggccgugugcuguucgaguguaaacuccacaagucuggauaugucaccguggcccauacuggccagcacgaucugguaauuccgccuaacggguacuuucgcuucgacuccugggugaaucaguucuauacccuugcacccaugggaaacgguacaggcagaaggcgguga

SEQ ID NO: 20481 - RNA, 1617 nt, Artificial Sequence
  derived and/or modified sequence opt3 from VP1__Norovirus_and/or_Norovirus-like__AB933662
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccauuuuuccuggugagcaguuacuguucuuuagguccaccaugcccggguguagcggcuauccaaauauggaucucgacugccuucugccucaggaguggguccagcauuucuaccaagaagcggcacccgcccagucggauguggcuuugcuacgguuuguuaacccagacacuggacgugugcuguucgaguguaaacuccacaagucuggcuaugucacgguggcccauacagggcagcacgaucugguaauaccgccuaacggauacuuucgcuucgacuccugggugaaucaguucuauacccuugcacccauggguaacggcacugggagaaggcgguga

SEQ ID NO: 20482 - RNA, 1617 nt, Artificial Sequence
  derived and/or modified sequence opt3 from VP1__Norovirus_and/or_Norovirus-like__AB933656
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguucacaaugugcaucuggccccugcaguagcuccaaccuuucccggugagcaguuacuguucuuuaggagcacuaugccuggguguucgggcuaucccaacauggaucucgacugccuucugccacaggaguggguccagcacuucuaccaagaagcggccccugcacagucugauguggcuuugcuacgguuuguuaaucccgacacgggacgugugcuguucgaguguaaacuccauaaguccggcuaugucacaguggcccacaccgggcagcacgaucugguaauuccaccgaacggauacuuucgcuucgacucaugggugaaccaguucuauacucuugcaccuauggguaauggcaccgggagaaggcgguga

SEQ ID NO: 20483 - RNA, 1617 nt, Artificial Sequence
  derived and/or modified sequence opt3 from VP1__Norovirus_and/or_Norovirus-like__EU921340
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcacccaggaguacacgaugaaccucgcaagccagaauuggaacaauuaugaucccacugaagagauuccugcuccacuggguacacccgacuucguagggaagauccagggaguucuuacccaaacuacacggcgcgacggcucuacccgaggccacaaggccacgguguccaccgggucaguccauuuuacaccuaagcugggaagaauccaguucagcacugauaccaguaacgacuuugaaacaggucagaauacuagguucaccccagugggcgucgugcaagaugggucuacaacccaccagaacgagccccagcaguggguuuugccggacuacuccggacgggauagccacaaugugcaucucgcuccugccguagcaccaucguuucccggcgaacaacuguuauucuuucguucuacuaugccugguuguuccggguaccccaacaugaaucuggacugccuccuuccacaggaguggguccagcacuucuaucaggaggccgcuccugcgcaaucagauguggcacuguugcgcuuuguuaaccccgacacgggcagagugcuauucgaauguaaacugcauaagaguggauacgucacaguggcccacaccggccagcacgaucucguaauuccaccgaauggguauuuuagguucgacagcugggugaaccaguucuacacucuggcuccuaugggaaacgguaccggccggcgacgcuga

SEQ ID NO: 20484 - RNA, 1617 nt, Artificial Sequence
  derived and/or modified sequence opt3 from VP1__Norovirus_and/or_Norovirus-like__KC962453
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaaucaguccaaggaaugcacccggggagauucuuuggagcgccccucugggaccagauuugaaccccuacuuaucccaccuggcucggauguauaauggcuacgccgguggguucgaaguucaggugauccuagcgggaaacgcauuuacugccggcaaagucauuuucgcugccgugccuccaaauuuuccgacggagggccucucucccucgcagguaaccauguucccucauaucguuguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuauucccgucuuaacaaucgaggaaaugaccaauagccgcuuuccaauaccccuggagaaacuuuucacgggaccuuccucagcguucgugguucagccacagaacgguagauguaguacugauggcguguugcuggggaccacacaacuaagcccggucaauauuugcacuuuuaggggagacgugacccauaucgccggcucucacaacuacacaaugaaucucgcaucccagaacuggaacucauaugaucccaccgaggaaauuccugcuccacuggguacgcccgacuucguagggaagauccagggaguucuuacucagacaacccgggccgacggcagcacucgcggccauaaggcuacagugcugaccgggagugccaauuuuacgccuaaguugggacgaauccaauucgcaaccgauacagacaaugauuuugagacuaaccagaauaccaaauucacaccagucggugugauucaggacggcgauacugcccacagaaacgaaccccaacaguggguccucccgucuuacuccgggaggaauacccacaacgugcaucuggcuccugcgguugcaccaacauuucccggagagcaguuacuguucuuucggagcaccauaccuggcuguucggguuaccccaauauggaccucgauugccuucugccacaggaaugggugcaauucuuuuaucaggaggccgcuccugcccagucugacguagcauugcuacguuucgucaaccccgauacugggcgcgugcuguuugaguguaagcuccacaaauccggcuacaucacgguugcccauacaggacagcacgaccuggugauuccaccgaacggcuauuucagauucgauucaugggucaaucaauuuuacacccuugcuccuauggggaacggaacugguaggcggcgauga

SEQ ID NO: 20485 - RNA, 1617 nt, Artificial Sequence
  derived and/or modified sequence opt3 from VP1__Norovirus_and/or_Norovirus-like__KF712501
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccuaucuuaacugucgaggaaaugacaaacagccgcuuucccauaccacuggagaaacuuuucaccggacccuccucaacguucgugguucagccucagaaugguagauguacuaccgauggcguguugcuggggacaacucaacuaaguccagucaacauuugcaccuuuaggggagacgugacacauaucaccggcagccggaauuacacgaugaaccucgccucucagaauuggaacuccuaugauccgacugaggaaauucccgcaccucuggguacaccagacuucguagggaagauccagggaguucuuacccagacuacacgcaccgacggcucaacgcgaggccacaaggcuaccguguacacagggagcgccgauuuuagucccaagcugggaagaguccaauucgcuacugacaccgauaaugacuuugauacaaaccagaauacuaaauucaccccugugggugucauccaggacggcgggacaacccauaggaacgagccacaacaguggguguugcccucuuacuccggacggaauacucacaacguucaccucgccccggcaguggccccuacguuuccaggcgaacagcuguuauucuuucguagcacaaugcccgguucgucuggguauccuaauauggaucuggacugucuccuuccccaggaguggguacaauacuucuaucaggaagcugcgccagcacaguccgaugucgcccuguugcgcuuugugaacccugacaccggcagaguucuauucgagugcaagcugcauaaaucaggauacgugacugucgcucacaccggccagcaugaucucgugauucccccaaacggguauuuuagguucgacaguuggguaaaucaauucuacacacuggccccgaugggaaacgguaccggccggcgacgcuga

SEQ ID NO: 20486 - RNA, 1617 nt, Artificial Sequence
  derived and/or modified sequence opt3 from VP1__Norovirus_and/or_Norovirus-like__JX459903
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgaucaugacuuugaugccaaucagaauacaaaauucacuccagugggugucauccaggacggcgauaccgcucacaggaacgagccccaacaguggguguugccgagcuacagugggcguaauucucacaacguucaucucgcgccuacaguggcaccaaccuuucccggagaacagcuguuauucuuucgguccacuaugccuggcuguagcgguuaucccaauauggaccuggauugccuccuuccacaggaguggguacaauacuucuaucaggaagccgcuccugcccagucggacgucgcacuguugcgcuuugugaaccccgauacggggagaguucuauucgaguguaagcugcacaaaucuggcuacgugacagucgcccauaccggacagcacgaccucgugauuccaccgaauggcuauuuuagguucgacuccuggguaaaccaauucuacacucuggcuccuauggggaacggaaccggucggcgacgcuga

SEQ ID NO: 20487 - RNA, 1617 nt, Artificial Sequence
  derived and/or modified sequence opt3 from VP1__Norovirus_and/or_Norovirus-like__JX459629
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacauggaucucgacugccuucugccucaggaguggguccagcauuucuaccaagaagcggcacccgcccagucugauguggcuuugcuacgguuuguuaauccagacacgggacgugugcuguucgaguguaaacuccacaaguccggcuaugucacaguggcccauaccgggcagcacgaucugguaauuccgccuaacggauacuuucgcuucgacucaugggugaaccaguucuauacucuugcacccauggguaauggcaccgggagaaggcgguga

SEQ ID NO: 20488 - RNA, 1617 nt, Artificial Sequence
  derived and/or modified sequence opt3 from VP1__Norovirus_and/or_Norovirus-like__JX445165
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucucugcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacgggaccuucaaguacuuucgugguucagccacagaacgguagauguaccacagauggcguguugcuggggacuacccaacuaagcccggucaauauuugcacauuuaggggagacgugacccauaucacgggcucucggaacuacacuaugaaucucgccucccagaacuggaacucauaugaucccacagaggaaauuccugcgccacuggguacccccgacuucguagggaagauccagggaguucuuacucagacaacccgcacggacggcagcacccgaggccacaaggccacaguguacacugggagugcagaguuuucuccuaagcugggaagaguccaauucgcuaccgauacagacaaugauuuugacgccaaucagaacacuaaauucaccccagugggugucauccaggauggcgggacaacccauaggaaugaaccccaacaguggguguugccguccuacagcggacggaacacucacaauguucaccucgcuccugccguggcaccaacguuucccggcgagcagcuguuauucuuucguucgacaaugccugguuguucuggguaucccaacauggaccuggauugccuccuuccacaggaauggguacaacauuucuaccaggaggccgcuccugcgcaguccgacgucgcacuguugcgcuuugugaaucccgauaccggcagaguucuauucgaguguaagcugcacaaaucaggauaugugacugucgcccauaccggccagcacgaccucgugauuccaccgaacggguacuuuagguucgauaguuggguaaaccaauucuauacacuggcuccuaugggaaaugguaccggccggcgacgcuga

SEQ ID NO: 20489 - RNA, 1617 nt, Artificial Sequence
  derived and/or modified sequence opt3 from VP1__Norovirus_and/or_Norovirus-like__HM635156
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuauugauggcguguugcuggggaccacacaacuaaguccggucaauaucugcacuuuuaggggagacgugacccauauuacaggcagccggaacuacaccaugaaucucgccacgcagaacuggaacucuuaugaucccacugaggaaaucccugcaccacuggguacacccgacuucguagggaagauccagggaguucuuacccagacuacacgcgcugacggcuccacccgaggccacaaggccacgguguacaccgggucagcugauuuugccccuaagcugggaagaguccaauucgcaacagacacugauaaugacuuugaugccaaucagaacaccaaauucacaccagugggugucauucaggacggcaauacugcucauaggaacgagccccaacaguggguguugccgagcuacagugggcguaauucucacaacguucaccucgcgccugcaguggccccaaccuuucccggagaacagcuguuauucuuucgguccacaaugccuggcuguagcgguuaucccaauauggaucuggacugccuccuuccacaggaguggguacaauacuucuaucaggaagcugccccugcacagucggaugucgcccuguugcgcuuugugaaccccgacaccgggagaguucuauucgaguguaagcugcauaaaucuggcuacgugacugucgcucacacgggacagcaugaucucgugauaccaccgaacggcuauuuuagguucgacuccuggguaaaucaauucuacacacuggccccuauggggaacggaaccggucggcgacgcuga

SEQ ID NO: 20490 - RNA, 1617 nt, Artificial Sequence
  derived and/or modified sequence opt3 from VP1__Norovirus_and/or_Norovirus-like__JQ622197
augaagauggccagcaacgacgcuaaucccuccgauggcucugcagccucacuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggucuaccacacaccgaaaugaaccccagcaaugggugcucccguccuacagcggaggcaacguucacaaugugcaucuggccccugcaguagcuccaaccuuucccggugagcaguuacuguucuuuagaucgacuaugccuggguguucuggcuaucccaacauggaucucgacugccuucugccacaggaguggguccagcacuucuaccaagaagcggccccugcacaguccgauguggcuuugcuaagguuuguuaaucccgacacgggacgggugcuguucgaguguaaacuccauaagucaggcuaugucacaguggcccacaccgggcagcacgaucugguaauuccaccgaacggauacuuucguuucgacaguugggugaaccaguucuauacucuugcaccuauggguaauggcaccgggcgcagaagguga

SEQ ID NO: 20491 - RNA, 1617 nt, Artificial Sequence
  derived and/or modified sequence opt3 from VP1__Norovirus_and/or_Norovirus-like__JQ613520
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagucuggcuaugucacaguggcccauaccgggcagcacgaucugguaauuccguccaacggauacuuucgcuucgacucaugggugaaucaguucuauacucuugcaccuauggguaacggcaccgggagaaggcgguga

SEQ ID NO: 20492 - RNA, 1617 nt, Artificial Sequence
  derived and/or modified sequence opt3 from VP1__Norovirus_and/or_Norovirus-like__HQ456320
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccagauucacaccagucggcgugguucaagaugggucuaccacucaccagaaugaaccccagcaguggguguugccgaacuacuccggaagggacagccacaauguacaucucgcuccugccgucgcaccaacguuucccggcgagcaacuguuauucuuucggucgacaaugccugguuguucuggguaccccaacaugaaucuggauugccuccuuccacaggaaugggugcagcacuucuaucaggaguccgccccugcucaaucagacguugcgcuguugcguuuugugaaccccgauaccggccgcguccuauucgaguguaaacugcauaagaguggauacgugacuguagcacacaccggccagcacgaccucgugaucccaccgaacggguauuuuagauucgauagcuggguuaaucaguucuacacacuggccccuaugggaaacggugcuggcaggcggcgauga

SEQ ID NO: 20493 - RNA, 1617 nt, Artificial Sequence
  derived and/or modified sequence opt3 from VP1__Norovirus_and/or_Norovirus-like__AB541353
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacauggaucucgacugccuucugccucaggaguggguccagcauuucuaccaagaagcggcacccgcccagucugauguggcuuugcuacgguuuguuaauccagacacgggacgugugcuguucgaguguaaacuccacaaguccggcuaugucacaguggcccauaccgggcagcacgaucugguaauuccgccuaacggauacuuucgcuucgacucaugggugaaccaguucuauacucuugcacccauggguaauggcaccgggagaaggcgguga

SEQ ID NO: 20494 - RNA, 1617 nt, Artificial Sequence
  derived and/or modified sequence opt3 from VP1__Norovirus_and/or_Norovirus-like__AB541348
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucgcaacagacacugagaacgauuuugaaacccaucaaaauacaaaguucacuccugugggcgucauccaggacgggggaaccacacaccgaaacgagccacagcaaugggugcuccccagcuacaguggcagaaauguucacaacgugcaucuggccccggcuguagcgccuaauuuuccaggugaacaguuacuguucuuuaggucuaccaugcccggguguuccggcuauccuaacauggaucucgacugccuucugccccaggaguggguccagcacuucuaccaagaggcagccccagcucagagcgauguggccuugcuacgguuuguuaacccugacacuggacgugugcuguucgaauguaaacuccauaagucgggcuaugucacgguggcacacacagggcagcacgaucugguaauucccccaaauggauacuuucgcuucgacucuugggugaaccaguucuauacccuugccccgauggguaauggcacugggagaaggcgguga

SEQ ID NO: 20495 - RNA, 1617 nt, Artificial Sequence
  derived and/or modified sequence opt3 from VP1__Norovirus_and/or_Norovirus-like__AB541339
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaacaccacacaccgaaaugaaccccagcaaugggugcucccgaguuacucuggaagaaacguucagaaugugcaccuggccccugcaguagcuccaaccuuucccggcgagcaguuacuguucuuuagguccacuaugccugguuguagcggguaucccaacauggaucucgacugccuucugccacaggaguggguccaacauuucuaccaggaagcggccccugcacagucggauguggcuuugcuacgguuuguuaaccccgacacgggccgugugcuguucgaguguaaacuccacaagucuggauaugucacaguggcccauaccggccagcacgaucugguaauuccaccgaauggguacuuucgcuucgacuccugggugaaccaauucuauacucuugcaccuaugggaaaugguaccggcagaaggcgguga

SEQ ID NO: 20496 - RNA, 1617 nt, Artificial Sequence
  derived and/or modified sequence opt3 from VP1__Norovirus_and/or_Norovirus-like__AB541303
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgucuuuacccccaaauuggguuccgugcaguucucaacagacacugaaaaugauuuugagacccaucaaaacacaaaguucacuccugucggcgugauccaggacgggagcaccacacaccgaaaugaaccacagcaauggguucuccccaguuacucuggaagaaacgugcacaauguacaucuggcuccggcggucgcaccuaccuuuccaggcgagcaguuacuguucuuuagguccacuaugcccgguuguagcggguauccuaacauggaucucgacugccuucugccccaggagugggugcagcacuucuaccaagaagccgcuccagcccagucggauguugcauugcuacgguuugugaauccugacacgggccguguccuguucgaguguaaacuccauaagucuggauaugugacaguagcccacaccggccagcacgaucuggugauucccccaaacggguacuuucgcuucgacuccuggguuaaccaguucuauacucuugcuccgaugggaaaugguaccggcagaaggcgguga

SEQ ID NO: 20497 - RNA, 1617 nt, Artificial Sequence
  derived and/or modified sequence opt3 from VP1__Norovirus_and/or_Norovirus-like__GQ246799
augaagauggccagcaacgacgcuaaucccuccgauggcucugcagccaaccuggugccugagaucaauaacgaagucauggcgcucgagccaguugugggggcugccauugcagccccgguagcuggacagcaaaaugugauagaccccuggaucagaaacaauuucguccaggcaccugguggcgaauuuaccgugucaccaaggaacgcccccggggagauucuuuggagugcuccucugggaccagauuugaaucccuacuuaagccaccuggcccggauguauaacggcuacgcggguggguucgaaguucaggugaucccugcaggaaaugccuuuacagcuggcaaaauuaucuucgccgcagucccaccgaacuuucccacugagggccuauccccuucucaggugacgauguucccacauauaaucguagacguucgccaacucgagcccgugcugauuccucuuccagauguccgaaauaacuuuuaucacuacaaucagucgaacgacucaaccaucaagcugauugcuauguuguauacaccccuccgugccaacaaugcgggggaugacguguucacugugagcugcagaguccugaccaggccgaguccugauuuugacuucaucuuucugguucccccaacaguggaaucccggaccaaaccuuucacuguacccauacucacaguggaggaaaugaccaacucucgcuuuccaauucccuuagagaagcuguucacgggaccuagcuccgccuucgucgugcagccacagaaugguagauguacuaccgauggcguucuuuuggggacaacucaacugucaccggugaacaucugcaccuuuaggggagacgucacacauauugcaggcagucggaauuacaccaugaaccuagcuagccucaauuggaacaauuaugaucccacggaggaaaucccugccccacuggguacucccgacuucguggggaaaauccagggaguacuuacacagaccacuaaggaggacggcucuacacgcggccacaaggcuaccguuuacacgggguccgccgauuuuaccccuaaacugggaucagugcaguucgguacagacacugaaaacgauuuugagacccaucaaaauacaaaguucacuccagucggcgugauucaggacgggagcaccacacaccgaaacgaaccccagcaaugggucuugccgaguuacucuggaagaaaugugcacaacguucaucucgccccugcaguggcuccaaauuuucccggcgagcagcuguuauucuuuagguccaccaugccugguuguagcggguaucccaacauggaucuggacugccuccuuccacaggaguggguacagcacuucuaccaagaagcggccccugcacagucggaugucgcucuguugcgguuugugaaccccgacacuggccguguucuauucgaguguaaacugcauaagucuggauaugugacggucgcccacacaggccagcacgaucucgugauaccaccgaauggguacuuucgcuucgacuccuggguaaaccaguucuauacccuggcaccuaugggaaaugguacuggcagaaggcgguga

SEQ ID NO: 20498 - RNA, 1617 nt, Artificial Sequence
  derived and/or modified sequence opt3 from VP1__Norovirus_and/or_Norovirus-like__EU876886
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguagcgucaauauuugcaccuuucggggagacgugacacauaucgccggcacccaggaguacacgaugaaccucgcaucucagaauuggaacaauuaugauccgacugaagagauucccgcuccucuggguacaccagacuucguagggaagauccagggaguucuuacccaaacuacacgccgagacggcuccaccagaggccacaaagccacggugucaaccgggagcguccauuuuacacccaagcugggaaggauccaguucaguacugauaccucuaacgacuuugaaacaggucagaauacucgguucaccccugugggcgucgugcaagauggguccacaacccaccagaacgagccacagcaguggguuuugcccaauuacagcggacgugacggccacaacgugcaucucgcuccggccguagcaccuucguuuccaggugaacaacuguuauucuuucgcucuacuaugcccggguguuccggcuacccuaauaugaaccuggauugccuccuuccccaggaguggguccagcacuucuaucaggaggccgcuccagcgcaaucagacguggcacuguugagauuuguuaauccugauacgggaagggugcuauucgaauguaagcugcauaaaaguggcuacgucacaguggcccacaccgggcagcacgaccucguaauucccccaaacggauauuuucgguucgauagcugggugaaccaguucuacacucuggcuccgauggguaauggcaccgggcgacgcagauga

SEQ ID NO: 20499 - RNA, 1617 nt, Artificial Sequence
  derived and/or modified sequence opt3 from VP1__Norovirus_and/or_Norovirus-like__AB385630
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaaggaagacggcagcacacgcgggcacaaggcuaccguguacacgggaucugcccccuuuaccccuaaauuggguuccguccaguucucaacagacacugagaacgauuuugaaacccaucaaaauacaaaguucacuccagugggcgucauccaggacgggagcaccacacaccgaaacgagccccagcaaugggugcucccgaguuacucuggaagaaauguucacaacgugcaucuggccccugcaguagcuccaaccuuucccggcgagcaguuacuguucuuuagguccacuaugccugguuguagcggguaucccaauauggaucucgacugccuucugccacaggaauggguccagcacuucuaccaagaggcggccccugcacagucggauguggcuuugcuacgguuuguuaaccccgacacgggccgugugcuguucgaauguaaacuccauaagucuggauaugucacaguggcccacaccggccagcacgaucugguaauuccaccgaacggguacuuucgcuucgacuccugggugaaucaguucuauacucuugcaccuaugggaaacgguaccggcagaaggcgguga

SEQ ID NO: 20500 - RNA, 1617 nt, Artificial Sequence
  derived and/or modified sequence opt3 from VP1__Norovirus_and/or_Norovirus-like__KU182483
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccagauucacaccagucggcgugguucaagaugggucuaccacucaccagaaugaaccccagcaguggguguugccggacuacuccggaagggauagccacaacguacaucucgcuccugccgucgcaccaacguuucccggcgagcaacuguuauucuuucggucgacaaugccugguuguucuggguaccccaauaugaaccuggacugccuccuuccacaggaaugggugcagcacuucuaucaggaguccgccccugcucaaucagauguugcgcuguugcguuuugugaaucccgacaccggccgcguccuauucgaguguaaacugcauaagaguggauacgugacuguagcacacaccggccagcacgaucucgugaucccaccgaacggguauuuuagauucgacagcuggguuaaccaguucuacacacuggccccuaugggaaauggugcuggcaggcggcgauga

SEQ ID NO: 20501 - RNA, 1617 nt, Artificial Sequence
  derived and/or modified sequence opt3 from VP1__Norovirus_and/or_Norovirus-like__AB665364
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguucagaacgugcaccuggccccugcaguagcuccaaccuuucccggcgagcaguuacuguucuuuaggagcacuaugccugguuguucgggguaucccaauauggaucucgacugccuucugccacaggaguggguccaacauuucuaccaggaagcggccccugcacagucugauguggcuuugcuacgguuuguuaaccccgacacgggccgugugcuguucgaguguaaacuccacaaguccggauaugucacaguggcccauaccggccagcacgaucugguaauuccaccgaacggguacuuucgcuucgacucaugggugaaucaauucuauacucuugcaccuaugggaaacgguaccggcagaaggcgguga

SEQ ID NO: 20502 - RNA, 1617 nt, Artificial Sequence
  derived and/or modified sequence opt3 from VP1__Norovirus_and/or_Norovirus-like__AB663686
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucagucgaacgacucaacgaucaaguugauugcuaugcucuauaccccacugcgugccaacaaugcgggggaugacguguucacagucagcugcagaguucugacuaggcccaguccggauuuugacuucaucuuucucgugccucccaccguagaaucccggacaaaaccauucaccgugccuauauuaacugucgaggaaaugacaaacucucgcuuucccauuccacuggagaaacuuuucaccggacccagcuccgccuucgugguucagccucagaaugguagauguacgacugauggcguguugcuggggaccacacaacuaucaccagucaacaucugcacuuuuaggggagacgugacccauauugcaggcagucggaauuacacaaugaaccucgcuagccugucuuggaauaacuaugauccgaccgaggaaauccccgccccucuugguacgccagacuucguagggaagauccagggaguucugacucagacaaccaagggcgacggcuccacucgcgggcacaaggcuacaguguacaccggaucagcccccuuuacgccuaaauuggguagcguccaguucaguaccgauacagagaaugacuuugaaacucaucaaaacaccaaguucacaccagugggcgucauucaggaugggggaacuacccaccgaaaugagccccagcaaugggugcucccgucuuacuccggcagaaacguuccuaaugugcaccuggcaccagccguagcucccacauuuccuggugaacaguuacuguucuuuaggagcaccaugcccggguguucgggcuauccaaacauggaccucgauugccuucugccucaggaguggguccagcauuucuaccaagaggcggcacccgcccagucugacguggcuuugcuacgguuuguuaauccagauacuggacgugugcuguucgaauguaaacuccacaaguccggcuaugucacgguggcccauacagggcagcacgaccugguaauaccgccuaacggauacuuucgcuucgauucaugggugaaccaguucuauacccuugcacccauggguaauggcacugggagaaggcgguga

SEQ ID NO: 20503 - RNA, 1617 nt, Artificial Sequence
  derived and/or modified sequence opt3 from VP1__Norovirus_and/or_Norovirus-like__AB933702
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguuccuaacgugcaccuggcaccagccguagcucccaccuuuccuggcgagcaguuacuguucuuuaggagcacuaugcccgguuguucgggguauccaaauauggaucucgacugccuucugccucaggaguggguccagcauuucuaccaagaagcggcacccgcccagucugauguggcuuugcuacgguuuguuaacccagacacgggccgugugcuguucgaguguaaacuccacaaguccggauaugucacaguggcccauaccggccagcacgaucugguaauuccgccuaacggguacuuucgcuucgacucaugggugaaucaguucuauacucuugcacccaugggaaacgguaccggcagaaggcgguga

SEQ ID NO: 20504 - RNA, 1617 nt, Artificial Sequence
  derived and/or modified sequence opt3 from VP1__Norovirus_and/or_Norovirus-like__AB933685
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucgggacuacaccaugaaucucgcuagccugaacuggaauaacuaugauccgacggaagagauucccgccccucuugguacuccagacuucguagggaagauccagggaaugcugacacagaccacuaagggcgacggcucuacacgcgggcacaaggcuaccguuuacacgggauccgcccccuuuaccccuaaauuggguucagugcgauucagcacagauacugaaaaugacuuugagauccaucagaacaccaaguucacaccagucggcgugauucaagaugggaguacuacccacagaaaugaaccccagcaguggguccucccgucuuacuccggaagggacgcacacaacgugcaucuggccccugcuguugcgccaacauuucccggcgagcaauuacuguucuuucggagcaccaugccugguuguucgggguaucccaauauggaucucgacugccuucugccacaggagugggugcagcacuucuaccaggaagcagccccugcucaaucugauguagccuugcuacguuuugucaaccccgacacuggccgcgugcuguucgaguguaaacuccauaaguccggauauguuacgguggcacacacaggccagcacgaucuggucauaccaccgaauggguacuuuagauucgacucaugggugaaccaguucuauacccuugccccuaugggaaacgguacuggcaggcggcgauga

SEQ ID NO: 20505 - RNA, 1617 nt, Artificial Sequence
  derived and/or modified sequence opt3 from VP1__Norovirus_and/or_Norovirus-like__AB933645
augaagauggccagcaacgacgcuacccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcuccgccuucgugguucagccucagaacgguagauguaccacagacggcguguugcuggggacuacccaacuaucaccagucaauauuugcacauuuaggggagaugugacccauaucgcaggcagucggaacuacacgaugaaucucgcuagccugaacuggaauaacuaugacccgacugaagagauucccgccccucuugguacaccagauuucguagggaagauccagggaguucugacccagacuacaaagggcgacggcucuacccgcgggcacaaggcuacgguguacaccggauccgcccccuuuacaccuaaauuggguucaguccaguucagcacugacaccgaaaaugauuuugagacacaucaaaacacuaaguucaccccagugggcgucauccaggacgggggaacaacccaccgaaaugaaccccagcaaugggugcucccgaguuacucuggcagaaacguuccuaaugugcaccuggcaccagccguagcucccacuuuuccuggugagcaguuacuguucuuuagguccacgaugcccggguguagcggcuauccaaacauggaucucgacugccuucugccucaggaguggguccagcauuucuaccaagaagcggcacccgcccagucggauguggcuuugcuacgguuuguuaauccagacacaggacgugugcuguucgaguguaaacuccacaagucuggcuaugucaccguggcccauacugggcagcacgaucugguaauuccgccuaacggauacuuucgcuucgacuccugggugaaccaguucuauacccuugcacccauggguaauggcacagggagaaggcgguga

SEQ ID NO: 20506 - RNA, 1617 nt, Artificial Sequence
  derived and/or modified sequence opt3 from VP1__Norovirus_and/or_Norovirus-like__LC005706
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaaugcacacaacguucaucuggccccugcuguggcgccaaccuuucccggcgagcaguuacuguucuuuaggagcacuaugccugguuguucgggguaucccaauauggaucucgacugccuucugccacaggaguggguacagcacuucuaccaagaagcagccccugcucagucugaugucgccuugcuacgguuugugaaccccgacacgggccguguucuguucgaguguaaacuccauaaguccggauaugugacagucgcacacaccggccagcacgaucuggugauuccaccgaacggguacuuucgcuucgacucauggguaaaucaguucuauacucuugccccuaugggaaacgguaccggcagaaggcgguga

SEQ ID NO: 20507 - RNA, 1617 nt, Artificial Sequence
  derived and/or modified sequence opt3 from VP1__Norovirus_and/or_Norovirus-like__KM198562
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucauugugcagccucagaauggcagauguacuaccgacgggguuuugcugggaacaacucaacuauccccagugaacaucugcaccuuuaggggcgaugucacacauauugcagguucacgggacuacaccaugaaucucgcuagucugaacuggaauaacuaugauccgacggaagagauccccgccccucuugggacuccagacuucgugggaaagauccagggcguacugacacagaccacuaagggcgacgggagcacacgcggacacaaggcuaccguuuacacggguucugcccccuuuaccccuaaauugggcuccgugcaguucucaacagauacugaaaaugacuuugaggcacaucaaaacaccaaguucacaccagucggggugauucaggauggaggcacuacccaccgaaaugaaccccagcaauggguccucccgagcuacagugguagagacgugcacaacguucaucuggccccugcuguggcgccaacauuucccggggagcaguuacuguucuuuaggucuaccaugccuggcuguuccggauaucccaauauggaucucgacugccuucugccacaggaguggguacagcacuucuaccaagaagcagccccugcucagagcgaugucgccuugcuacgguuugugaaccccgacacuggccguguucuguucgaguguaaacuccauaagucgggguaugugacggucgcacacacaggacagcacgaucuggugauaccaccgaaugguuacuuucgcuucgacucuuggguaaaccaguucuauacccuugccccuaugggcaacgggacuggaagaaggcgguga

SEQ ID NO: 20508 - RNA, 1617 nt, Artificial Sequence
  derived and/or modified sequence opt3 from VP1__Norovirus_and/or_Norovirus-like__KC409311
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucgugcuagcgggaaacgcauuuacugccggcaaaauuaucuucgcugccguaccuccaaauuuuccgacggagggccucucucccucgcagguuaccauguucccucauaugauuguggacguccgccaacuggagccagugcuuaucccccugccugaugugcgaaacaauuuuuaucacuacaaccagucaaaugacccaacaauaaaguugaucgcaaugcucuauacuccccugcgugcuaacaacgccggggaugacgucuucaccguuagcugcagagugcugacaaggccgaguccugauuuugacuucauuuuucucguacccccaaccguggaaucccggacuaaaccuuucucuguccccaucuuaacaguggaggaaaugaccaauagccgcuuuccaauuccccuggagaaacuuuucacgggaccuuccucagcguucguugugcagccacagaacgguagauguacuaccgauggcgucuugcuggggacaacucaacuaaguccggugaauaucugcaccuuuaggggagacguaacacauauaaccggcagccacaacuacacgaugaaucucgccacucagaacuggaacucuuaugaucccacagaggaaauuccugcaccacuggguacccccgacuucguugggaagauccagggagugcuuacucagacaacccgggcugacggcuccacgcgcggccauaaggccaccgucuacacagggucagcugauuuugccccuaagcugggacgagugcaauucgcaacugacaccaauaaugauuugggugccaaccagaauacaaaauuuacuccagucggcgugauucaggacgggggaaccgcucacagaaacgagccccaacaguggguucucccgagcuacaguggcaggaacucucacaaugugcaucuggcgccugcaguagccccaacauuccccggugaacaguuacuguuuuuccgguccaccaugccuggguguagcggcuaucccaauauggaucucgacugccuucugccacaggaguggguccaauacuuuuaucaggaagcugccccugcacagucggauguggccuugcuacguuucguuaaccccgacacuggacgcgugcuguuugaguguaagcuccacaaaucuggcuacgucacgguggcucauacagggcagcacgaucugguaaucccaccgaacggauauuucagauuugacuccugggugaaucaauucuacacccuugccccuauggguaacggcacugggaggcggcgauga

SEQ ID NO: 20509 - RNA, 1617 nt, Artificial Sequence
  derived and/or modified sequence opt3 from VP1__Norovirus_and/or_Norovirus-like__KC409263
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacgggacuacaccaugaaucucgcuagucugaacuggaauaacuaugauccgacggaagagauucccgccccucuugggacuccagacuucguaggaaagauccagggcguucugacacagaccacuaagggcgacgggagcacacgcggacacaaggcuaccguguacacggguucugcccccuuuaccccuaaauugggcuccguccaguucucaacagauacugaaaaugacuuugaggcacaucaaaacaccaaguucacaccagugggggucauccaggauggaggcacuacccaccgaaaugaaccccagcaaugggugcucccgagcuacagugguagagacguucacaacgugcaucuggccccugcuguagcgccaacauuucccggggagcaguuacuguucuuuaggucuaccaugccuggcuguuccggauaucccaauauggaucucgacugccuucugccacaggaguggguccagcacuucuaccaagaagcagccccugcucagagcgauguggccuugcuacgguuuguuaaccccgacacuggccgugugcuguucgaguguaaacuccauaagucgggguaugucacgguggcacacacaggacagcacgaucugguaauuccaccgaaugguuacuuucgcuucgacucuugggugaaccaguucuauacccuugccccuaugggcaacgggacuggaagaaggcgguga

SEQ ID NO: 20510 - RNA, 1617 nt, Artificial Sequence
  derived and/or modified sequence opt3 from VP1__Norovirus_and/or_Norovirus-like__JX459900
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccuaucuuaacugucgaggaaaugacaaacagccgcuuucccauaccacuggagaaacuuuucaccggacccuccucaacguucgugguucagccucagaaugguagauguacuaccgauggcguguugcuggggacaacucaacuaaguccagucaacauuugcaccuuuaggggagacgugacacauaucgccggcagccggaauuacaccaugaaccucgcaucucagaauuggaacuccuaugauccgacggaggaaauucccgcuccucuggguacuccagacuucguagggaagauccagggaguucuuacacagaccacucgcacagacggcucaacccgaggccacaaggccacgguguacaccgggagcgcugauuuuagucccaagcugggaagaguccaauucgccacagacacugauaaugacuuugaugcaaaccagaauaccaaauucacaccugugggugucauccaggacggcaacacugcccauaggaaugagccacaacaguggguguugcccucuuacuccgggcggaacacccacaauguucaccucgcuccggcgguggcaccuacauuuccaggagaacagcuguuauucuuucguagcaccaugcccggcuguucggguuauccuaacauggaucuggacugccuccuuccccaggaguggguacaauacuucuaucaggaagccgcuccagcccagucugaugucgcacuguugcgcuuugugaacccugacacugggagaguucuauucgaguguaagcugcauaaauccggcuacgugacggucgcccacacaggacagcaugaucucgugauucccccaaauggcuauuuuagguucgacucauggguaaaccaauucuacacccuggcuccgauggggaauggaacuggucggcgacgcuga

SEQ ID NO: 20511 - RNA, 1617 nt, Artificial Sequence
  derived and/or modified sequence opt3 from VP1__Norovirus_and/or_Norovirus-like__JX459617
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguucacaacgugcaucuggccccugcaguagcuccaaccuuucccggcgagcaguuacuguucuuuaggagcacuaugccugguuguucgggguaucccaauauggaucucgacugccuucugccacaggaguggguccagcacuucuaccaagaagcggccccugcacagucugauguggcuuugcuacgguuuguuaaccccgacacgggccgugugcuguucgaguguaaacuccauaaguccggauaugucacaguggcccacaccggccagcacgaucugguaauuccaccgaacggguacuuucgcuucgacucaugggugaaucaguucuauacucuugcaccuaugggaaacgguaccggcagaaggcgguga

SEQ ID NO: 20512 - RNA, 1617 nt, Artificial Sequence
  derived and/or modified sequence opt3 from VP1__Norovirus_and/or_Norovirus-like__GQ845366
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaauuacaguggcagaaacguuccuaaugugcaccuggcaccagccguagcucccaccuuuccuggugagcaguuacuguucuuuaggucuacuaugcccggguguuccggcuauccaaacauggaucucgacugccuucugccucaggaguggguccagcauuucuaccaagaagcggcacccgcccagagcgauguggcuuugcuacgguuuguuaacccagacacgggacgugugcuguucgaguguaaacuccacaagucgggcuaugucacaguggcccauaccgggcagcacgaucugguaauuccgucuaauggauacuuucgcuucgacuccugggugaaccaguucuauacucuugcaccuauggguaauggcaccgggagaaggcgguga

SEQ ID NO: 20513 - RNA, 1617 nt, Artificial Sequence
  derived and/or modified sequence opt3 from VP1__Norovirus_and/or_Norovirus-like__GQ845345
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauaugaaccccuacuugucccacuuagcucggauguauaauggcuacgccgguggguucgaagugcaggucauucuggcgggaaacgcauuuacugccggcaaaaucauuuucgcugccgugccuccaaauuuuccgacggagggccuaucucccucgcagguaaccauguucccucauaucauaguugacgugcgccaacucgagccaguccugaucccccuuccugaugugcgaaacaauuuuuaucacuacaaccagucaaaugacccaacaauuaagcugaucgcaauguuguauacuccccuccgugcuaacaacgccggggaugacguguucaccgucagcugcagaguucugacaaggccgaguccugauuuugacuucauuuuucuggugcccccaaccguagaaucccggacuaaaccuuucucugugcccauccucacagucgaggaaaugaccaauagccgcuuuccaauacccuuagagaagcuguucacgggaccuuccucagcguucgugguucagccacagaacgguagauguacuaccgauggcgugcuuuuggggacaacucaacugaguccggucaauauuugcaccuuuaggggagacgugacacauaucgccggcagccggaacuacaccaugaaucuagcaucucagaacuggaacuccuaugaucccacggaggaaauuccugcuccacucgguacucccgacuucguagggaaaauccagggaguucugacacagaccacucgcacagacggcucaacccgaggccacaaggccacgguguacaccgggagcgcugauuuuaguccuaaacuuggaagaguccaauucgccacagacacugauaaugacuuuguggcaaaucagaacaccaaguucacaccagucggugugauccaggauggcaauacugcccauaggaacgagccccaacaguggguucugccgucuuacuccgggcggaauacccacaacgugcacuuggcuccugcgguagcaccaacauuucccggagaacagcuccuguucuuucguagcaccaugccuggcuguucggguuaucccaauauggacuuagauugccugcucccacaggaguggguccaauacuucuaucaggaagccgcuccugcccagucugacguggcacuucugcgcuuuguuaaccccgauacugggagaguguuguucgaguguaagcuacauaaauccggcuacgucacgguggcccacacaggacagcaugaccugguaauuccaccgaacggcuauuuuagguucgauucaugggugaaucaauucuacacccucgcuccuauggggaacggaacuggucggcgacgcuga

SEQ ID NO: 20514 - RNA, 1617 nt, Artificial Sequence
  derived and/or modified sequence opt3 from VP1__Norovirus_and/or_Norovirus-like__GQ845341
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcggugccuucgugguucagccucagaauggcagauguacuaccgaugggguguugcugggaacaacucaacuauccccagucaacauuugcaccuuuaggggcgacgugacacauaucgcagguucacgggauuacaccaugaaucucgcuagucugaacuggaauaacuaugacccgacggaggaaauucccgccccucuugggacuccagacuucguaggaaagauccagggcguucugacacagaccacugagggcgaugggagcacacgcggacacaaggcuaccguguacacggguucugcccccuuuaccccuaaguugggcuccguccaguucucaacagacacugaaaaugauuuugagacccaucaaaacacaaaauucacuccagugggggucauccaggacggaagcaccacacaccgaaaugaaccccagcaaugggugcucccgaguuacucuggcagaaacguucacaaugugcaucuggccccugcaguagcuccaaccuuucccggugagcaguuacuguucuuuagguccacuaugccuggguguagcggcuaucccaacauggaucucgacugccuucugccacaggaguggguccagcacuucuaccaagaagcggccccugcacagucggauguggcuuugcuacgguuuguuaaucccgacacgggacgugugcuguucgaguguaagcuccauaaaucuggcuaugucacaguggcccacaccgggcagcacgaucugguaauuccaccgaacggauacuuucgcuucgacuccugggugaaccaguucuauacucuugcaccuauggguaauggcaccgggagaaggcgguga

SEQ ID NO: 20515 - RNA, 1617 nt, Artificial Sequence
  derived and/or modified sequence opt3 from VP1__Norovirus_and/or_Norovirus-like__HQ005292
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccggaacuacaccaugaaucucgcaacgcagaacuggaacucuuaugaucccacugaggaaauuccugcuccacuggguacacccgacuucguagggaagauccagggaguucuuacccagacuacacgcgccgacggcuccacccgaggccacaaggcuacgguguacaccgggucagccgauuuuagcccuaagcugggaagaguccaauucgcaacagacacugauaaugacuuugaugccaaucagaacaccaaauucacaccagugggugucauccaggacggcaauacugcucauaggaacgagccccaacaguggguguugccgaguuacucugggcguaauucccacaacguucaccucgcgccugcaguggccccaaccuuucccggagaacagcuguuauucuuucggagcacaaugccuggcuguucggguuaucccaauauggaucuggacugccuccuuccacaggaguggguacaauacuucuaucaggaagcugccccugcacagucugaugucgcccuguugcgcuuugugaaccccgacaccgggagaguucuauucgaguguaagcugcauaaauccggcuacgugacugucgcucacacgggacagcaugaucucgugauuccaccgaacggcuauuuuagguucgacucauggguaaaucaauucuacacacuggccccuauggggaacggaaccggucggcgacgcuga

SEQ ID NO: 20516 - RNA, 1617 nt, Artificial Sequence
  derived and/or modified sequence opt3 from VP1__Norovirus_and/or_Norovirus-like__HQ456321
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuguaaaucucgcaagucagaacuggaauaacuaugaucccacagaggaaauuccugcuccacuggguacccccgacuucguugggaagauccagggagugcuuacucaaacaacccggcgcgacggcagcacgcgaggccacaaggccaccgucucuacaggguccgugcauuuuacuccuaagcugggaucaguccaguucagcaccgauacaaguaaugacuuugagacuggucagaacaccagauucacaccagugggcguugugcaagaugggucuaccacucaccagaaugaaccccagcaguggguauugccgaacuacuccggaagggacagccacaauguccaucucgcuccugccguggcaccaacguuucccggcgagcaacuguuauucuuucggucgacaaugccugguuguucuggguaccccaacaugaaucuggauugccuccuuccacaggaauggguucagcacuucuaucaggaguccgccccugcucaaucagacguggcgcuguugcguuuugucaaccccgauaccggccgcgugcuauucgaguguaaacugcauaagaguggauacguaacuguggcacacaccggccagcacgaccucguuaucccaccgaacggguauuuuagauucgauagcugggucaaucaguucuacacacuggccccuaugggaaacggugcuggcaggcggcgauga

SEQ ID NO: 20517 - RNA, 1617 nt, Artificial Sequence
  derived and/or modified sequence opt3 from VP1__Norovirus_and/or_Norovirus-like__AB541326
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucaccggcagucggaauuacacgaugaaccucgcaagccugaauuggaacaauuaugauccgacugaggaaauucccgcuccucuugguacaccagacuucguagggaagauccagggaguucugacccagacuacaaagggcgacggcucuacccgcgggcacaaggccacgguguacaccggauccgcugauuuuacacccaaauuggguucaguccaguucgccacugacaccgagaacgauuuugaaacacaucaaaauacuaaguucaccccugugggcgucauccaggacgggggaacaacccaccgaaacgagccacagcaaugggugcuccccagcuacaguggcagaaauguucacaacgugcaucuggcaccggccguagcuccuaauuuuccaggugaacaguuacuguucuuuaggucuacuaugcccggguguuccggcuauccuaacauggaucucgacugccuucugccccaggaguggguccagcacuucuaccaagaggcggcaccagcccagagcgauguggcuuugcuacgguuuguuaacccugacacgggacgugugcuguucgaauguaaacuccauaagucgggcuaugucacaguggcccacaccgggcagcacgaucugguaauucccccaaauggauacuuucgcuucgacucuugggugaaccaguucuauacucuugcaccgauggguaauggcaccgggagaaggcgguga

SEQ ID NO: 20518 - RNA, 1617 nt, Artificial Sequence
  derived and/or modified sequence opt3 from VP1__Norovirus_and/or_Norovirus-like__AB541251
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucguaucucugaacuggaauaacuaugacccgacggaagagauucccgcuccucuugguacuccagauuucguugggaagauccagggagugcugacacagaccacuaagggcgacggcuccacacgcgggcacaaggccaccgucuacacgggaucagcucccuuuaccccuaaauuggguagcgugcaguucaguacagacacugaaaaugauuuugagacccaucaaaacacaaaguucacuccagucggcgugauccaggacgggucuaccacacaccgaaaugaaccccagcaauggguucucccguccuacagcggaagaaacgugcacaauguacaucuggccccugcagucgccccaaccuuucccggcgagcaguuacuguucuuuaggucgacuaugccugguuguucuggguaucccaacauggaucucgacugccuucugccacaggagugggugcagcacuucuaccaagaagcugcgccugcacaguccgauguugccuugcuacgguuugugaaucccgacacgggccguguccuguucgaguguaaacuccauaagucaggauaugugacaguagcuuacaccggccagcacgaucuggugauuccaccgaacggguauuuucgcuucgacaguuggguuaaccaguucuacacucuugccccuaugggaaaugguaccggcagaaggcgguga

SEQ ID NO: 20519 - RNA, 1617 nt, Artificial Sequence
  derived and/or modified sequence opt3 from VP1__Norovirus_and/or_Norovirus-like__AB541241
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaaucgagucccggaccaaaccauucacuguaccuauauuaacaguggaagagaugaccaacucucgcuuucccauuccacuggagaaacuuuucacgggacccagcggugccuucgucgugcagccucagaauggcagauguacuaccgacgggguuuugcugggaacaacucaacuauccccagugaacaucugcaccuuuaggggcgaugucacacauauugcagguucacgggacuacaccaugaaucucgcuagucugaacuggaauaacuaugauccgacggaagagauccccgccccucuugggacuccagacuucgugggaaagauccagggcguacugacacagaccacuaagggcgacgggagcacacgcggacacaaggcuaccguuuacacggguucugcccccuuuaccccuaaauugggcuccgugcaguucucaacagauacugaaaaugacuuugagacccaucaaaacacaaaguucacuccagucggggugauucaggauggaagcaccacacaccgaaaugaaccccagcaauggguccucccgaguuacucuggcagaggugugcacaacguucaucuggccccugcaguggcuccaaccuuucccggggagcaguuacuguucuuuagguccacuaugccuggcuguagcggauaucccaauauggaccucgauugccuucugccacaggaguggguacagcacuucuaccaagaagcggccccugcacagucggacgucgcuuugcuacgguuugugaaccccgauacgggccguguucuguucgaguguaaacuccauaagucuggguaugugacagucgcccacaccggacagcacgaccuggugauaccaccgaaugguuacuuucgcuucgauuccuggguaaaccaguucuauacucuugcaccuaugggcaacgggaccggaagaaggcgguga

SEQ ID NO: 20520 - RNA, 1617 nt, Artificial Sequence
  derived and/or modified sequence opt3 from VP1__Norovirus_and/or_Norovirus-like__AB541216
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgccgacuuuacccccaaauuggguucaguccaguucagcacagauacugaaaacgacuuugagacccaucaaaauacaaaguucacuccugugggcgucauccaggaugggggaaccacacaccgaaacgaaccacagcaaugggugcuccccaguuacucuggcagaaauguucacaacgugcaucuggcaccggccguagcuccuaccuuuccaggugagcaguuacuguucuuuagguccacuaugcccggguguagcggcuauccuaauauggaccucgauugccuucugccccaggaguggguccagcacuucuaccaagaagcggcaccagcccagucggacguggcuuugcuacgguuuguuaacccugauacgggacgugugcuguucgaguguaaacuccauaagucuggcuaugucacaguggcccacaccgggcagcacgaccugguaauucccccaaacggauacuuucgcuucgauuccugggugaaucaguucuauacucuugcaccgauggguaacggcaccgggagaaggcgguga

SEQ ID NO: 20521 - RNA, 1617 nt, Artificial Sequence
  derived and/or modified sequence opt3 from VP1__Norovirus_and/or_Norovirus-like__EU876885
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguccggccaauauuugcaccuuucggggagacgucacacauaucgcaggcacccaggaguacacgaugaaccucgcuagccagaauuggaacaauuaugaucccacugaagagauuccugccccacuggguacacccgacuucguggggaagauccagggaguacuuacccaaacuacacgccgagacggcucuaccagaggccacaaagcuacgguuuccaccgggucagugcauuuuacaccuaagcugggaaggauccaguucagcacugauaccaguaacgacuuugaaacaggucagaauacucgguucaccccagucggcgugguccaagaugggggaacaacccaccagaacgagccccagcaguggguguugccgaauuacucuggccgugacggucacaacguucaucucgccccugcaguggccccauccuuucccggggaacaacuguuauucuuucgcagcacuaugccuggcuguucgggauaccccaauaugaaccuggauugccuccuuccacaggaguggguacagcacuucuaucaggaggcugcgccugcacaaucugacgucgcccuguugagauuugugaaucccgauacgggcaggguucuauucgaauguaagcugcauaaauccggguacgugacagucgcucacaccggacagcacgaccucgugauuccaccgaacgguuauuuucgguucgauucauggguaaaccaguucuacacucuggccccuaugggcaaugggaccggacgacgcagauga

SEQ ID NO: 20522 - RNA, 1617 nt, Artificial Sequence
  derived and/or modified sequence opt3 from VP1__Norovirus_and/or_Norovirus-like__AB447435
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaauugaacgacucgacaauuaagcucaucgcuaugcuguauacuccacugcgugccaacaaugcgggggaagauguguucaccgucucaugcagaguucucacaaggcccagcccggacuuugauuucauuuuucuggugccucccaccguagagagucggacuaaaccauucacagugccuauccugaccgucgaagagaugacgaacucccgcuuucccauaccacuugagaaguuguucacuggacccucuggugccuucgugguucagccucagaauggcagauguaccacagacggggugcugcuaggaacuacccagcucagcccagucaacauuugcacauuuaggggcgaugugacccauaucgcagguucccggaauuacacgaugaaccuggcuucacuuaauuggaacaauuaugacccgacugaagagauucccgccccucuggggacaccagauuucguaggaaaaauccaaggcguuuugacccagacuacaaagggcgacgggaguacccgcggacacaaggcuacgguguacaccgguagcgcccccuuuacaccuaaacucggcucuguccaguucuccacugacaccgaaaacgauuuugagacacaucagaauacuaaguucaccccagugggggucauccaagacggaucaacaacccaccgaaacgaaccccagcagugggugcugccgagcuacaguggcagaaauguucacaacgugcauuuagccccugcaguagcuccaacuuuucccggugagcaauuacucuucuuuaggucuacgaugccuggguguuccggcuaucccaauauggaucuugacugccuguugccacaggaguggguccagcacuucuaccaggaagcggccccugcacaaagcgauguggcucuacugcgguuuguuaaccccgacacaggacguguccucuucgaguguaaacugcauaagucgggcuaugugaccguggcccacacugggcagcacgaucuuguaauuccaccgaacggauacuuucgcuucgacucuugggugaaucaguucuauacccuggcaccuauggguaacggcacagggagaaggcgguga

SEQ ID NO: 20523 - RNA, 1617 nt, Artificial Sequence
  derived and/or modified sequence opt3 from VP1__Norovirus_and/or_Norovirus-like__KX354073
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucgcaacagacacugagaacgauuuugaaacccaucaaaauacacgauucacuccugugggcgucauccaggacgggagcaccacacacagaaacgagccacagcaaugggugcuccccaguuacucuggaaggaauguucacaacgugcaucuggccccggcuguagcgccuaauuuuccaggcgaacaguuacuguucuuucgguccaccaugcccgguuguagcggguauccuaacauggaucucgacugccuucugccccaggaguggguccagcacuucuaccaagaggcagccccagcucagucggauguggccuugcuacguuuuguuaacccugacacuggccgcgugcuguucgaauguaagcuccauaaaucuggauaugucacgguggcacacacaggccagcacgaucugguaauucccccaaauggguacuuuagauucgacuccugggugaaccaguucuauacccuugccccgaugggaaaugguacuggcaggcggcgauga

SEQ ID NO: 20524 - RNA, 1617 nt, Artificial Sequence
  derived and/or modified sequence opt3 from VP1__Norovirus_and/or_Norovirus-like__KX353981
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguucagaacgugcaccuggccccugcaguagcuccaaccuuucccggugagcaguuacuguucuuuagguccacuaugccuggguguagcggcuaucccaauauggaucucgacugccuucugccacaggaguggguccaacauuucuaccaggaagcggccccugcacagucggauguggcuuugcuacgguuuguuaaccccgacacgggacgugugcuguucgaguguaaacuccacaagucuggcuaugucacaguggcccauaccgggcagcacgaucugguaauuccaccgaacggauacuuucgcuucgacuccugggugaaucaauucuauacucuugcaccuauggguaacggcaccgggagaaggcgguga

SEQ ID NO: 20525 - RNA, 1617 nt, Artificial Sequence
  derived and/or modified sequence opt3 from VP1__Norovirus_and/or_Norovirus-like__KU182479
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcgcacagaacuacacgaugaaucucgcuagucagaacuggaauaacuaugaucccacugaggaaauuccugccccacuggguacacccgacuucguagggaagauccagggaguucuuacccaaacuacacggcgcgacggcagcacccgaggccacaaggcuacggugucuaccggguccguccauuuuacaccuaagcugggaucagugcaguucagcacugauaccaguaaugacuuugagacaggucagaacacuagauucaccccagucggcgugguucaagaugggucuacaacccaccagaaugaaccccagcaguggguguugccggacuacuccggaagggauagccacaacguacaucucgccccugcagucgccccaacuuuucccggcgagcaacuguuauucuuucggucgacgaugccugguuguucuggguaccccaauaugaaccuggacugccuccuuccacaggaaugggugcagcacuucuaucaggaguccgcuccugcgcaaucagauguugcacuguugcguuuugugaaucccgacacaggccgcguccuauucgaguguaaacugcauaagaguggauacgugaccguagcccacacuggccagcacgaucucgugaucccaccgaacggguauuuuagauucgacagcuggguuaaccaguucuacacccuggcuccuaugggaaauggugccggcaggcggcgauga

SEQ ID NO: 20526 - RNA, 1617 nt, Artificial Sequence
  derived and/or modified sequence opt3 from VP1__Norovirus_and/or_Norovirus-like__KU182478
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccagauucacaccagucggcgugguucaagaugggucuaccacucaccagaaugaaccccagcaguggguguugccggacuacuccggaagggauagccacaacguacaucucgcuccugccgucgcaccaacguuucccggcgagcaacuguuauucuuucggucgacaaugccugguuguucuggguaccccaauaugaaccuggacugccuccuuccacaggaaugggugcagcacuucuaucaggaguccgccccugcucaaucagauguugcgcuguugcguuuugugaaucccgacaccggccgcguccuauucgaguguaaacugcauaagaguggauacgugacuguagcacacaccggccagcacgaucucgugaucccaccgaacggguauuuuagauucgacagcuggauuaaccaguucuacacacuggccccuaugggaaauggugcuggcaggcggcgauga

SEQ ID NO: 20527 - RNA, 1617 nt, Artificial Sequence
  derived and/or modified sequence opt3 from VP1__Norovirus_and/or_Norovirus-like__AB972501
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucggcacagacacugaaaacgauuuugagacccaucaaaauacaaaguucacuccagugggggucauccaggacggaggcaccacacaccgaaacgaaccccagcaaugggugcucccgagcuacagugguagaaauguuccuaacgugcaccuggcaccagccguagcucccaccuuuccuggggagcaguuacuguucuuuaggucuacuaugcccggcuguuccggauauccaaauauggaucucgacugccuucugccucaggaguggguccagcauuucuaccaagaagcggcacccgcccagagcgauguggcuuugcuacgguuuguuaacccagacacgggccgugugcuguucgaguguaaacuccacaagccgggguaugucacaguggcccauaccggacagcacgaucugguaauuccucccaacgguuacuuucgcuucgacucgugggugaaucaguucuauacucuugcaccaaugggcaacgggaccggaagaaggcgguga

SEQ ID NO: 20528 - RNA, 1617 nt, Artificial Sequence
  derived and/or modified sequence opt3 from VP1__Norovirus_and/or_Norovirus-like__KR904214
augaagauggccagcuccgacgcuaaccccucugugggcucagcagccaaucuggucccugagguuaacaaugaagugauggcgcucgagccaguagugggggcugccaucgcagccccggucgcuggacagcaaaacgugauugaucccuggauaagaaauaacuucguucaggcaccugguggcgaauuuaccgugaguccaaggaaugcccccggggagauccuuuggagcgcuccucugggaccagacuugaaccccuacuuaucccaccuggcccggauguauaauggcuacgcggguggguucgaaguccuagugauucucgcaggaaacgccuuuacagcuggcaaaaucauuuucgccgcaguaccuccaaauuuuccgacugagggccugucucccucgcagguuacgauguucccucauaucauaguggauguccgccagcuugagccagugcugauccccuugccugacgugcgaaacaauuuuuaucacuacaaccaaucaaaugauccaaccauuaagcucaucgcuaugcuguauacaccccugcgugccaacaacgcgggggacgaugucuucacuguuagcugcagagugcucaccaggccgaguccugacuuugauuucaucuuuuuaguacccccaacaguggaaucccggaccaaaccuuucucuguccccauucugacuguggaggaaaugacaaauagccgcuuuccaauaccccuugagaaguuguucaccggaccuuccucagccuucguugugcagccacagaacgguagauguacgacugacggcguccugcuagggaccacacagcucaguccggugaauauuugcacuuuuaggggagauguaacccauacaaccggcagccacaacuacacgaugaaucuggcaacucaaaacuggaacucuuaugaccccacagaggaaaucccugcuccacuugguacccccgauuucguugggaaaauucagggagugcugacucagacaaccaagacggacggcuccacccggggccauaaggccacagucuacacugggucagcugacuuugccccuaaauugggacgcgugcaguucgcaaccgauacagacaaugauuuugaggccaaucaaaacacuaaguucaccccagucggugugauccaggacggcgggacagcucaccgaaaugaaccccagcaauggguucucccgagcuacaguggaagaaacacccacaaugugcaucuggcgccugcaguagccccaacuuuucccggcgagcaguuacuguucuuuaggucuacgaugccugguuguuccggguaucccaacauggaucucgacugccuucugccacaggaauggguccaguacuucuaucaagaggcugccccugcacagagcgauguggccuugcuacgguuuguuaaucccgacacaggccgugugcuguucgaguguaaacuccacaagucgggauacgucaccguggcucauacuggcccacacgaucugguaaucccgccuaacggguauuuucgcuucgacucuugggugaaccaguucuacacccuugcccccaugggaaaugguacaggcagaaggcgguga

SEQ ID NO: 20529 - RNA, 1617 nt, Artificial Sequence
  derived and/or modified sequence opt3 from VP1__Norovirus_and/or_Norovirus-like__AB933758
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccacaacuacaccaugaaucucgcaucucagaacuggaacuccuaugaucccacggaggaaauuccugcuccacuggguacucccgacuucguagggaagauccagggaguucuuacacagaccacucggacagacggcucaacccgcggccauaaggccacgguguacaccgggagcgcugaguuuaguccuaagcugggacgaguccaauucgccacagauacuaauaaugacuuugaugcaaaccagaauaccaaauucacaccagugggugucauccaggacggcgggacuacccacagaaacgaaccccaacaguggguguugccgucuuacuccggaaggaauacacacaacguucaucucgccccugcuguggcgccaaccuuucccggcgagcagcuguuauucuuucggagcacuaugccugguuguucgggguaucccaauauggaucuggacugccuccuuccacaggaauggguacaauacuucuaucaggaggcagccccugcucagucugaugucgcccuguugcguuuugugaaccccgacacgggccgcguucuauucgaguguaagcugcacaaauccggauacgugacagucgcacauaccggccagcacgaucucgugauuccaccgaacggguauuuuagauucgacucauggguaaaucaauucuacacucuggccccuaugggaaacgguaccggcaggcggcgauga

SEQ ID NO: 20530 - RNA, 1617 nt, Artificial Sequence
  derived and/or modified sequence opt3 from VP1__Norovirus_and/or_Norovirus-like__AB933698
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaagggcgaugugacacauaucgcagguucaaggaauuacaccaugaaccucgcuagucugaauuggaacaauuaugacccgacggaagagauucccgccccucuugggacuccagauuucguaggaaagauccagggcguucugacacagaccacuaagggcgacgggagcacacggggacacaaagcuaccguguacacggguucugcccccuuuaccccuaaguugggcuccguccaguucucaacagacacugaaaacgauuuugagacccaucaaaauacaaaauucacuccagugggggucauccaggacggaggcaccacacaccagaacgaaccccaacagugggugcucccgagcuacaguggucgcgauguuccuaaugugcaccuggcaccagccguagcucccaccuuuccuggggagcaguuacuguucuuucgaucuacuaugcccggcuguuccggauauccaaacaugaaucucgacugccuucugccucaggaguggguccaacauuucuaccaggaagcggcacccgcccagagcgauguggcuuugcuaagauuuguuaacccagacacgggcagggugcuguucgaguguaagcuccacaaaucgggguaugucacaguggcccauaccggacagcacgaucugguaauuccgccuaacgguuacuuucgguucgacucuugggugaaucaauucuauacucuugcacccaugggcaacgggaccggacgucgcagauga

SEQ ID NO: 20531 - RNA, 1617 nt, Artificial Sequence
  derived and/or modified sequence opt3 from VP1__Norovirus_and/or_Norovirus-like__KJ678141
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucacaauuacaccaugaaccucgcaucccagaauuggucaaacuaugaucccacggaggaaauaccugcuccacuggguacucccgacuucgucgggaagauucagggagugcuuacacagaccacucggacaaauggcagcacccgcggccauaaggccacggucuacgcugggagugccaacuuugcaccuaagcugggacgagugcaauucgagaccgacacagaucacgacuuggaagccaaucagaacacuaaauuuaccccaguuggugugauccaggauggcaauacaacucacagaaacgagccccaacaguggguacucccgucuuacuccgggaggagcaccccuaauguccaucuggcuccagcgguggcacccacauucccuggagaacaguuacuguuuuuccggucgaccaugcccggcuguucugguuauccaaacauggaccucgauugccuucugccucaggaguggguucaauacuuuuaucaggaggccgcucccgcccaguccgacguggcauugcuacguuucgucaauccagauacugggcgcgugcuguuugaauguaagcuccacaaaucaggcuacguaacgguggcccauacaggacagcacgaccugguuauuccgccuaacggcuauuucagauuugauaguugggucaaccaauucuacacccuugcucccauggggaauggaacugguaggcggcgauga

SEQ ID NO: 20532 - RNA, 1617 nt, Artificial Sequence
  derived and/or modified sequence opt3 from VP1__Norovirus_and/or_Norovirus-like__EU921347
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcagguccuacucgcgggaaacgcauuuacugccggcaaaauuaucuucgcugccgugccuccaaauuuuccgacggagggccugucucccucgcagguaaccauguucccucauauuaucguugacgugcgccaacuugagccaguccugauacccuugccugaugugcgaaacaauuuuuaucacuacaaccagucaaaugacccaacaaucaagcucauugcaaugcuguauacuccccugcgugcuaacaacgccggggaugacguguucaccgucagcugcagaguucucacaaggccgaguccugauuuugacuucaucuuuuuagugcccccaaccguagaaucccggacuaaaccuuucucugugcccauucugacagucgaggaaaugaccaauagccgcuuuccaaucccccuugagagauuguucacgggaccuuccucagcguucgugguucagccacagaacgguagguguacuaccgauggcgugcugcuagggacaacucaacucaguccggucaauauaugcaccuuucggggagacgugacacauauugccggcacccaggaguacacgaugaaccuggcaagccagaauuggaacaauuaugaucccacugaagagaucccugcuccacuugguacacccgacuucguagggaagauucagggaguucugacccaaacuacacgccgagacggcucuaccagaggccacaaagccacgguguccaccgggucaguccauuuuacaccuaaguugggaaggauccaguucagcacugauaccaguaacgacuuugaaacaggucagaauacucgguucaccccagugggcgucgugcaagaugggggaacaacccaccagaacgagccccagcaguggguucucccggacuacucuggccgugauucccacaaugugcaucuggcuccugccguagcacccagcuuuccaggugaacaauuacuguucuuucgcucgacuaugccuggguguucuggcuaccccaacaugaaucucgacugccuucugccacaggaguggguccagcacuucuaucaggaggccgcuccugcgcaauccgauguggcauugcuaagauuuguuaaccccgacacgggaagggugcuguucgaauguaagcuccauaaaucaggcuacgucacaguggcccacaccgggcagcacgaucugguaaucccaccgaauggauauuuucgguucgacaguugggugaaccaguucuacacucuugcuccuauggguaacggcaccgggcgacgcagauga

SEQ ID NO: 20533 - RNA, 1617 nt, Artificial Sequence
  derived and/or modified sequence opt3 from VP1__Norovirus_and/or_Norovirus-like__JX459628
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcugcccugaauuggaacaauuaugacccgacggaagagauucccgcuccucuugggacuccagauuucguaggaaagauccagggcguucugacacagaccacuaagggcgacgggaguacacgcggacacaaggccaccguguacacggguagcgcagacuuuacccccaaauugggcucuguccaguucuccacagauacugaaaacgacuuugagacccaucaaaauacaaaguucacuccugugggggucauccaggauggaucaaccacacaccgaaacgaaccacagcaaugggugcuccccagcuacaguggcagaaauguucacaacgugcaucuggccccggcuguagcgccuaccuuuccaggugagcaguuacuguucuuuaggucuacuaugcccggguguuccggcuauccuaauauggaccucgauugccuucugccccaggaguggguccagcacuucuaccaagaagcagccccagcucagagcgacguggccuugcuacgguuuguuaacccugauacgggacgugugcuguucgaguguaaacuccauaagucgggcuaugucacaguggcacacaccgggcagcacgaccugguaauucccccaaacggauacuuucgcuucgauucuugggugaaucaguucuauacucuugccccgauggguaacggcaccgggagaaggcgguga

SEQ ID NO: 20534 - RNA, 1617 nt, Artificial Sequence
  derived and/or modified sequence opt3 from VP1__Norovirus_and/or_Norovirus-like__JQ613564
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaccgccggcagccacaacuacacgaugaaucucgcaucucagaacuggaacuccuaugaucccacugaggaaaucccugcuccacuggguacacccgacuucguagggaagauucagggaguucuuacccagacuacacgggccgacggcucaacccgcggccauaaggcuacgguguacaccgggagcgccgaguuuaguccuaagcugggacgaguccaauucgcaacagauacugacaaugauuuugacgccaaucagaacaccaaauucacaccagugggugucauccaggauggcgggacuacccacagaaaugaaccccaacaguggguguugccgucuuacuccggaaggaacacacacaauguucaucucgcuccugcgguggcaccaaccuuucccggcgagcagcuguuauucuuucggagcacuaugccugguuguucgggguaucccaacauggaccuggauugccuccuuccacaggaauggguacaauacuucuaucaggaggccgcuccugcccagucugacgucgcacuguugcguuuugugaaucccgauacgggccgcguucuauucgaguguaagcugcacaaauccggauacgugacagucgcccauaccggccagcacgaccucgugaucccaccgaacggguauuuuagauucgauucauggguaaaccaauucuacacucuggcuccuaugggaaaugguaccggcaggcggcgauga

SEQ ID NO: 20535 - RNA, 1617 nt, Artificial Sequence
  derived and/or modified sequence opt3 from VP1__Norovirus_and/or_Norovirus-like__GQ845332
augaagauggccagcaacgacgcuaaucccuccaacggcucugcagccaaucuggugccugaggucaacaaugaaguuauggcgcucgagccagugguaggggcugccaucgcagccccgguggcuggacagcaaaacgucauugaucccuggauaagaaauaacuucgugcaggcaccugguggcgaauuuaccguuucaccaaggaaugcccccggggagauccuuuggagugcuccucugggaccagacuugaaccccuacuuaagccaccuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucauaucauaguugaugugcgccaacuggagccaguccuuaucccccugccugacgugcgaaacaauuuuuaucacuacaaccagucgaacgauucaaccauuaaguugaucgcuaugcucuauacaccacugcgugccaauaacgcgggggaagacguguucacugucagcugcagaguucugaccaggcccaguccggauuuugacuucauuuuucucgugccucccacaguagagucccggaccaaaccauucacugugccuaucuuaacagucgaagagaugaccaauucucgcuuucccauaccacuggagaaacuuuucacgggacccagcuccgccuucgugguucagccucagaacgguagauguacuaccgauggcguguugcuggggacaacucaacuaucaccagucaauauuugcaccuuuaggggagacgugacacauaucgcaggcagucggaacuacaccaugaaucucgcuagccugaacuggaauaacuaugauccgacggaagagauucccgccccucuugguacuccagacuucguagggaagauccagggaguucugacacagaccacuaagggcgauggcucuacacgcgggcacaaggcuaccguguacacgggauccgcccccuuuaccccuaaauuggguucaguccaguucagcacagacacugaaaaugacuuugagacccaucaaaacacaaaguucacuccagugggcgucauccaggaugggggaaccacacaccgaaaugaaccccagcaaugggugcucccgaguuacucuggcagaaacguuccuaaugugcaccuggcaccagccguagcucccaccuuuccuggugagcaguuacuguucuuuagguccacuaugcccggguguagcggcuauccaaacauggaccucgauugccuucugccucaggaguggguccagcauuucuaccaagaagcggcacccgcccagucggacguggcuuugcuacgguuuguuaacccagauacgggacgugugcuguucgaguguaaacuccacaagucuggcuaugucacaguggcccauaccgggcagcacgaccugguaauuccgccuaauggauacuuucgcuucgauuccugggugaaccaguucuauacucuugcacccauggguaauggcaccgggagaaggcgguga

SEQ ID NO: 20536 - RNA, 1617 nt, Artificial Sequence
  derived and/or modified sequence opt3 from VP1__Norovirus_and/or_Norovirus-like__GQ856461
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucauggggaagauccagggaguacugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggggaaccacacaccgaaacgaaccccagcaauggguccucccgaguuacucuggcagaaaugugccuaacguucaccuggcaccagccguggcucccaccuuuccuggugagcaguuacuguucuuuagguccacuaugcccggguguagcggcuauccaaauauggaucucgacugccuucugccucaggaguggguacagcauuucuaccaagaagcggcacccgcccagucggaugucgcuuugcuacgguuugugaacccagacacgggacguguucuguucgaguguaaacuccacaagucuggcuaugugacagucgcccauaccgggcagcacgaucuggugauuccgccuaacggauacuuucgcuucgacuccuggguaaaucaguucuauacucuugcacccauggguaacggcaccgggagaaggcgguga

SEQ ID NO: 20537 - RNA, 1617 nt, Artificial Sequence
  derived and/or modified sequence opt3 from VP1__Norovirus_and/or_Norovirus-like__AB541245
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagauaucacacauauugcaggcagucggaauuacaccaugaaccucgcuagccugaauuggaacaauuaugacccgacggaagagauccccgccccucuugguacuccagauuucguggggaagauccagggaguacugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauucaggacgggaguaccacacaccgaaacgaaccccagcaauggguccucccgucuuacuccggaagaaaugcacacaacgugcaucuggccccugcuguugcgccaaccuuucccggcgagcaguuacuguucuuuaggagcacuaugccugguuguucgggguaucccaauauggaucucgacugccuucugccacaggagugggugcagcacuucuaccaagaagcagccccugcucagucugauguagccuugcuacgguuugucaaccccgacacgggccgugugcuguucgaguguaaacuccauaaguccggauauguuacaguggcacacaccggccagcacgaucuggucauaccaccgaacggguacuuucgcuucgacucaugggugaaucaguucuauacucuugccccuaugggaaacgguaccggcagaaggcgguga

SEQ ID NO: 20538 - RNA, 1617 nt, Artificial Sequence
  derived and/or modified sequence opt3 from VP1__Norovirus_and/or_Norovirus-like__AB541229
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguucagaacgugcaccuggccccugcaguagcuccaaccuuucccggcgagcaguuacuguucuuuaggagcacuaugccugguuguucgggguaucccaauauggaucucgacugccuucugccacaggaguggguccaacauuucuaccaggaagcggccccugcacagucugauguggcuuugcuacgguuuguuaaccccgacacgggccgugugcuguucgaguguaaacuccacaaguccggauaugucacaguggcccauaccggccagcacgaucugguaauuccaccgaacggguacuuucgcuucgacucaugggugaaucaauucuauacucuugcaccuaugggaaacggugccggcagaaggcgguga

SEQ ID NO: 20539 - RNA, 1617 nt, Artificial Sequence
  derived and/or modified sequence opt3 from VP1__Norovirus_and/or_Norovirus-like__AB541226
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacauuaugaaccucgcuagccugaauuggaacaauuaugacccgaccgaagagauccccgccccucuugguacgccagauuucguagggaagauccagggaguucugacucagacaaccaagggcgacggcucuacucgcgggcacaaggcuacaguguacaccggauccgcccccuuuacgccuaaauuggguucaguccaguucagcaccgacacagaaaacgauuuugagacucaucaaaauaccaaguucacaccagugggcgucauucaggacgggaguacuacccaccgaaacgaaccccagcaaugggugcucccgucuuacuccggaagaaauguucacaacgugcaucuggccccugcaguagcuccaacauuucccggcgagcaguuacuguucuuuaggagcaccaugccugguuguucgggguaucccaauauggaucucgacugccuucugccacaggaguggguccagcacuucuaccaagaagcggccccugcacagucugauguggcuuugcuacgguuuguuaaccccgacacuggccgugugcuguucgaguguaaacuccauaaguccggauaugucacgguggcccacacaggccagcacgaucugguaauaccaccgaacggguacuuucgcuucgacucaugggugaaucaguucuauacccuuacuccuaugggaaacgguaccggcagaaggcgguga

SEQ ID NO: 20540 - RNA, 1617 nt, Artificial Sequence
  derived and/or modified sequence opt3 from VP1__Norovirus_and/or_Norovirus-like__DQ078814
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagguacucucccccucucagguuacaauguucccucauaucauaguggacguccgccaacuggagccagugcuuaucccccugccugaugugcgaaacaauuuguaucacuacaaccagucgaaugacccaacuauucgucucaucgcaaugcuguauacgccccugagagcuaacaacgccggcgaugacgucuuuacaguuucaugcagggugcucacccggccgagcccugauuucgacuuuauuuucuuaguacccccaacuguggaaagucgcacaaagccuuuuuccguccccauccugaccguggaggaaaugaccaauucuagauucccaauaccccuugagaaauuguuuacugggccuagcuccgcguucguugugcagccacagaacggaagguguaccacagaugguguccugcuaggcacuacccaacucucaccggugaauauuugcacauuccgcggggacguaacccauaucgccggaacgcagaacuacacuaugaaucuggcaagucagaacuggaauaacuaugaucccacagaggaaauuccugcuccacuuggcacccccgacuuuguuggucggauccagggggugcugacucaaacaacccgaagagacggaagcacgaggggccacaaggccaccgucucuacaggcuccgugcauuucacuccuaaauuggggucaguccaguuuagcaccgauacaaguaaugacuucgagacuggacagaacacccgguuuacaccaguggguguugugcaagauggcucuaccacucaccagaaugaaccccagcaguggguacucccggacuacuccgggcgugauagccacaacguccaucuggcuccugccguggcaccaacguuccccggagagcaauuacuguuuuuccgcucgacaaugccuggcuguucugguuaccccaauaugaaccucgacugccuucugccacaggaauggguucagcacuuuuaucaggaguccgccccugcucaaucagauguggcguugcuaagauucgucaaucccgacaccgggagggugcuguuugaguguaagcuccauaagaguggcuacguaacuguggcacacaccggacagcacgaucugguuaucccaccgaacggcuauuuccgguuugacagcugggucaaccaguucuacacacuugccccuauggggaauggagcuggucgacgcagauga

SEQ ID NO: 20541 - RNA, 1617 nt, Artificial Sequence
  derived and/or modified sequence opt3 from VP1__Norovirus_and/or_Norovirus-like__EU078416
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucucugugccuaucuuaacugucgaagagaugacaaacagccgcuuucccauaccacuggagaaacuuuucaccggacccuccucagccuucgugguucagccucagaaugguagauguacgacugacggcguguugcuggggaccacacaacuaaguccagucaacauuugcacuuuuaggggagaugugacccauaucgcaggcacacaggaauacaccaugaaucucgcuagccagaacuggaauaacuaugacccgacggaggaaauucccgccccucuggguacuccagauuucguagggaagauccagggaguucuuacacaaaccacucggcgcgacggcucuacacgaggccacaaggcuaccguguccacggggucaguccauuuuacccccaagcugggaagaauccaguucagcacagacaccaguaaugauuuugagacuggucagaacacaagguucacuccugugggcgucgugcaagacgggucuaccacacaccagaaugaaccacagcaguggguuuugcccaacuacuccggacgggauagccacaaugugcaucucgccccggcaguagccccuucguuuccaggcgagcaacuguuauucuuucguucuaccaugcccgguuguuccggguacccuaacauggaccuggauugccuccuuccccaggaguggguccagcacuucuaucaggaagcugcgccagcacaaucagacguggcccuguugcgcuuuguuaauccugauacuggcagagugcuauucgaguguaaacugcauaagaguggauacgucacgguggcucacacaggccagcacgaccucguaauucccccaaacggguauuuuagguucgauagcugggugaaccaguucuacacccuggccccgaugggaaaugguacuggccggcgacgcuga

SEQ ID NO: 20542 - RNA, 1617 nt, Artificial Sequence
  derived and/or modified sequence opt3 from VP1__Norovirus_and/or_Norovirus-like__EU839590
augaagauggccagcaacgacgcuaaucccuccggcgggucugcagccaaccuggugccugaggucaauaacgaaguuauggcgcucgagccagugguaggagcugccaucgcagccccgguggcuggucagcaaaaugucauugaucccuggauaagaaacaauuucgugcaggcaccuggcggggaauuuaccguuucaccaaggaacgcccccggagagauccuuuggagugcuccucugggcccagacuugaaucccuacuuaagccaccuggcccggauguauaacgguuacgcagggggauucgaagugcaggucauucuagcaggcaaugccuuuacagcuggcaaaaucauuuucgccgcagugccuccaaacuuuccgacugaggggcucucccccucucagguaacgauguucccucauaucauaguugaugugcgccaacuggagccaguccuuaucccccugccugacgugcgaaauaacuuuuaucacuacaaucagucgaacgauucaaccauuaaguugaucgcuaugcucuauacaccacugcgugccaacaaugcgggagaagacguguucacugucagcugcagaguucugaccaggcccaguccggauuuugacuucauuuuucucgugccucccacaguagagucccggaccaaaccauucacugugccuaucuuaacagucgaagagaugaccaacucucgcuuucccauaccacuggagaaacuuuucacgggucccagcuccgccuucgugguucagccucagaauggcagauguacuaccgaugggguguugcugggaacaacucaacuaucaccagucaacauuugcaccuuuaggggcgacgugacacauaucgcagguagucggaauuacaccaugaaccucgcuagccugaauuggaacaauuaugauccgacggaagagauucccgccccucuugggacuccagacuucguaggaaagauccagggcguucugacacagaccacuaagggcgaugggucuacacgcggacacaaggcuaccguguacacggguuccgcccccuuuaccccuaaauugggcucaguccaguucagcacagacacugaaaacgacuuugagacccaucaagauacaaaguucacuccagugggggucauccaggacggaggcaccacacaccgaaaugaaccccagcaaugggugcucccgaguuacucugguagaaacguucagaaugugcaccuggcgccugccguagcuccaaccuuucccggggagcaguuacuguucuuuagguccacuaugccuggcuguagcggauaucccaacauggaucucgacugccuucugccacaggaguggguccaacauuucuaccaggaagcggccccugcacagucggauguggcuuugcuacgguuuguuaaucccgacacgggccgugugcuguucgaguguaaacuccacaagucuggguaugucacaguggcccauaccggacagcacgaucugguaauuccaccgaacgguuacuuucgcuucgacuccugggugaaccaauucuauacucuugcaccuaugggcaaugggaccggaagaaggcgguga

SEQ ID NO: 20543 - RNA, 1617 nt, Artificial Sequence
  derived and/or modified sequence opt3 from VP1__Norovirus_and/or_Norovirus-like__AB294783
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggggcgacggcagcacgcgcgggcacaaggccaccgugucuacaggauccguccauuuuacuccuaagcuggguucagugcaguucagcaccgauacaaguaaugacuuugagacuggccagaacacccgauucacaccagucggggugguucaagauggaucuaccacucaccagaaugaaccccagcaguggguguugccgaacuacuccggcagagacagccacaauguacaucucgcuccugccgucgcaccaacguuucccggugagcaacuguuauucuuuaggucgacaaugccuggguguucuggcuaccccaacaugaaucuggauugccuccuuccacaggaaugggugcagcacuucuaucaggaguccgccccugcucaaucagacguugcgcuguugcgguuugugaaccccgauaccggacguguccuauucgaguguaaacugcauaagaguggcuacgugacuguagcacacaccgggcagcacgaccucgugaucccaccgaacggauauuuucgcuucgauagcuggguuaaucaguucuacacacuggccccuauggguaacggcgcugggagaaggcgguga

SEQ ID NO: 20544 - RNA, 1617 nt, Artificial Sequence
  derived and/or modified sequence opt3 from VP1__Norovirus_and/or_Norovirus-like__AB303941
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccauccauuuuacuccuaagcugggaucaguccaguucagcaccgauacaaguaaugacuuugagacuggucagaacaccagauucacaccagugggcgucgugcaagaugggucuaccacucaccagaaugaaccccagcaguggguuuugccggacuacuccggaagggauagccacaacgugcaucucgcuccugccguagcaccaacguuucccggcgagcaacuguuauucuuucggucgacaaugccugguuguucuggguaccccaauaugaaccuggacugccuccuuccacaggaauggguccagcacuucuaucaggaguccgccccugcucaaucagauguggcgcuguugcguuuuguuaaucccgacaccggccgcgugcuauucgaguguaaacugcauaagaguggauacgucacuguggcacacaccggccagcacgaucucguaauuccaccgaacggguauuuuagauucgacagcugggugaaccaguucuacacacuggccccuaugggaaauggugcuggcaggcggcgauga

SEQ ID NO: 20545 - RNA, 1617 nt, Artificial Sequence
  derived and/or modified sequence opt3 from VP1__Norovirus_and/or_Norovirus-like__EF126961
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugaggcuggucagaacacuagauucaccccagucggcgugguucaagaugggucuacaacccaccagaaugaaccccagcaguggguguugccggacuacuccggaagggauagccacaacguacaucucgccccugcagucgccccaacuuuucccggcgagcaacuguuauucuuucggucgacgaugccugguuguucuggguaccccaauaugaaccuggacugccuccuuccacaggaaugggugcagcacuucuaucaggaguccgcuccugcgcaaucagauguugcacuguugcguuuugugaaucccgacacaggccgcguccuauucgaguguaaacugcauaagaguggauacgugaccguagccuauacuggccagcacgaucucgugaucccaccgaacggguacuuuagauucgacagcuggguuaaccaguucuauacccuggcuccuaugggaaauggugccggcaggcggcgauga

SEQ ID NO: 20546 - RNA, 1617 nt, Artificial Sequence
  derived and/or modified sequence opt3 from VP1__Norovirus_and/or_Norovirus-like__LC153749
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaagacacaaaguucacuccagugggcgucauccaggaugggggaaccacacaccgaaaugaaccccagcaaugggugcucccgaguuacucuggcagagacguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagucuggcuaugucacaguggcccauaccgggcagcacgaucugguaauuccgccuaauggauacuuucgcuucgacuccugggugaaccaguucuauacucuugcacccauggguaacggcaccgggagaaggcgguga

SEQ ID NO: 20547 - RNA, 1617 nt, Artificial Sequence
  derived and/or modified sequence opt3 from VP1__Norovirus_and/or_Norovirus-like__KX371610
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgguacagacacugaucaugacuuugaggcaaaccagaguaccaaauucacaccaguuggcgugauccaggaugggucuacuacccacaggaaugaaccccaacaguggguauugccguccuacagcggacggaacacaccuaauguccaccucgccccagcuguggcgcccaccuuuccuggcgagcagcuguuauucuuucguucgacuaugcccgguuguucuggguauccaaacauggaccuggauugccuccuuccucaggaauggguucaauacuucuaucaggaggcagcccccgcucaguccgacguggcccuguugcgcuuugucaauccagauacgggcagagugcuauucgaguguaagcugcauaaaucaggauacguaacaguggcacacaccggccagcaugaccucguuauuccgccuaacggguauuuuagguucgauaguugggucaaucaauucuacacucuggcccccaugggaaacgguaccggccggcgacgcuga

SEQ ID NO: 20548 - RNA, 1617 nt, Artificial Sequence
  derived and/or modified sequence opt3 from VP1__Norovirus_and/or_Norovirus-like__KX354031
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgguacagacacugaucaugacuuugaggcaaaucagaacaccaaauucacaccaguuggcgugauccaggaugggagcacuacccacaggaaugaaccccaacaguggguauugccgaguuacucuggacggaacacacacaauguccaucucgccccugcuguggcgccaaccuuucccggcgagcagcuguuauucuuucguuccacuaugccugguuguagcggguaucccaacauggaccuggauugccuccuuccacaggaauggguucaauacuucuaucaggaggcagccccugcucagucggacguggcccuguugcgcuuugucaaucccgauacgggcagagugcuauucgaguguaagcugcacaaaucuggauacguaacaguggcacauaccggccagcacgaccucguuauuccaccgaacggguauuuuagguucgauuccugggucaaccaauucuacacucuggccccuaugggaaaugguaccggccggcgacgcuga

SEQ ID NO: 20549 - RNA, 1617 nt, Artificial Sequence
  derived and/or modified sequence opt3 from VP1__Norovirus_and/or_Norovirus-like__KX353990
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaacucucgcuuuccaaucccccuggagaaacuuuucacgggaccuagcuccgcguucguugugcagccacagaaugguagauguacuaccgauggcgucuugcuggggacaacucaacuaucaccggugaacauaugcaccuuuaggggagacguaacacauauugccggcagucggaauuacaccaugaaccucgcaagccagaauuggaacucuuaugaucccacggaggaaaucccugcuccacuggguacucccgacuucguugggaagauucagggagugcuuacacagaccacucgcacagacggcuccacccgaggccacaaggccacggucuacaccgggucagcugauuuuagcccuaagcugggaagagugcaauucgccacagacacugauaaugacuuugagaccaaccagaauacaaaauucacuccagucggugugauccaggauggcgggaccacacauaggaacgaaccccaacaguggguuuugccgaguuacucuggacggaauacccacaacgugcaccucgccccugcaguagcuccaacuuuucccggcgagcagcuguuauucuuucguuccacgaugccugguuguagcggguaucccaauauggaccuggauugccuccuuccacaggaauggguccaauacuucuaucaggaggcggccccugcacagucggacguggcucuguugcgcuuuguuaaccccgauacaggcagagugcuauucgaguguaagcugcauaaaucuggauacgucaccguggcccacacuggccagcaugaccucguaaucccaccgaacggguauuuuagguucgauuccugggugaaucaauucuacacccuggcaccuaugggaaacgguacaggccggcgacgcuga

SEQ ID NO: 20550 - RNA, 1617 nt, Artificial Sequence
  derived and/or modified sequence opt3 from VP1__Norovirus_and/or_Norovirus-like__KX353972
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaacucucgcuuuccaaucccccuggagaaacuuuucacgggaccuagcuccgcguucguugugcagccacagaaugguagauguacuaccgauggcgucuugcuggggacaacucaacuaucaccggugaacauaugcaccuuuaggggagacguaacacauauuaccggcagucggaauuacacgaugaaccucgccagccagaauuggaacucuuaugaucccacugaggaaaucccugcaccacuggguacacccgacuucguugggaagauucagggagugcuuacccagacuacacgcaccgacggcuccacgcgaggccacaaggcuaccgucuacacagggucagccgauuuuagcccuaagcugggaagagugcaauucgcuacugacaccgauaaugacuuugagacaaaccagaauacuaaauucaccccagucggugugauccaggauggcgggacaacccauaggaacgaaccccaacaguggguuuugccgaguuacucuggacggaauacucacaacgugcaccucgccccugcaguagccccaacguuucccggcgagcagcuguuauucuuucguuccacaaugccugguuguagcggguaucccaauauggaccuggauugccuccuuccacaggaauggguccaauacuucuaucaggaggcugcgccugcacagucggacguggcccuguugcgcuuuguuaaccccgauaccggcagagugcuauucgaguguaagcugcauaaaucuggauacgucacuguggcucacaccggccagcaugaccucguaaucccaccgaacggguauuuuagguucgauuccugggugaaucaauucuacacacuggccccuaugggaaacgguaccggccggcgacgcuga

SEQ ID NO: 20551 - RNA, 1617 nt, Artificial Sequence
  derived and/or modified sequence opt3 from VP1__Norovirus_and/or_Norovirus-like__KX353968
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucgcaacagacacugagaacgauuuugaaacccaucaaaauacacgauucacuccugugggcgucauccaggacgggggaaccacacacagaaacgagccacagcaaugggugcuccccagcuacaguggcaggaauauucacaacguucaucuggccccggcuguggcgccuaauuuuccaggugaacaguuacuguucuuucggucuaccaugcccggguguuccggcuauccuaacauggaucucgacugccuucugccccaggaguggguacagcacuucuaccaagaggcagccccagcucagagcgaugucgccuugcuacguuuugugaacccugacacuggacgcguucuguucgaauguaagcuccauaaaucgggcuaugugacggucgcacacacagggcagcacgaucuggugauacccccaaauggauacuuuagauucgacucuuggguaaaccaguucuauacccuugccccgauggguaauggcacugggaggcggcgauga

SEQ ID NO: 20552 - RNA, 1617 nt, Artificial Sequence
  derived and/or modified sequence opt3 from VP1__Norovirus_and/or_Norovirus-like__KX353967
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucgcaacagacacugagaacgauuuugaaacccaucaaaauacacgauucacuccugugggcgucauccaggacgggggaaccacacacagaaacgagccacagcaaugggugcuccccagcuacaguggcaggaauauucacaacguucaucuggccccggcuguggcgccuaauuuuccaggugaacaguuacuguucuuucggucuaccaugcccggguguuccggcuauccuaacguagaucucgacugccuucugccccaggaguggguccagcacuucuaccaagaggcagccccagcucagagcgauguggccuugcuacguuuuguuaacccugacacuggacgcgugcuguucgaauguaagcuccauaaaucgggcuaugucacgguggcacacacagggcagcacgaucugguaauacccccaaauggauacuuuagauucgacucuugggugaaccaguucuauacccuugccccgauggguaauggcacugggaggcggcgauga

SEQ ID NO: 20553 - RNA, 1617 nt, Artificial Sequence
  derived and/or modified sequence opt3 from VP1__Norovirus_and/or_Norovirus-like__KX353966
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagaucacgauguucccucauauaaucguagacguucgccaacuggagccagugcuuauuccccugccugauguccgaaauaacuuuuaucacuacaaucagucgaacgacucaaccaucaaguugauugcuaugcucuauacaccacugcgugccaacaaugcgggggaugacguguucacugugagcugcagaguccugaccaggcccaguccggauuuugacuucaucuuucucguuccucccacaguggaaucccggaccaaaccauucacuguaccuauauuaacaguggaggaaaugaccaacucucgcuuucccauuccacuggagagacuuuucacgggacccagcuccgccuucgucgugcagccucagaaugguagguguacuaccgauggcguuuugcuggggacaacucaacuaucaccagugaacaucugcaccuuucggggagacgucaaucauauugcaggcagucgcaacuacacaaugaaucucgcuagccugaacuggaauaacuaugauccgaccgaggaaacgcccgccccucuugguacuccagacuucguggggaagauccagggaguacugacacagaccacucgaggcaauggcucuacaagagggcacagggcuaccguuuacacgggauccgccgacuuuacccccaaauugggucggauccaguucgcaacagauacugacaacgauuuugagacccaucaaaauacaaaguucacuccugugggcgucauucaggacgggaacaccacacaccguaaugaaccacagcaaugggugcuccccucauacagcggacgcaacguccagaacgugcaccuggccccggcuguugcgccuaauuuuccaggcgagcaguuacuguucuuuagaaguaccaugcccgguuguucuggguauccuaacauggaucucgacugccuucugccccaggaaugggugcaacauuucuaccaggaggcagccccagcucaguccgauguagccuugcuaagguuugucaauccugacacuggccgggugcuguucgaguguaagcuccacaaaagcggauuuguuacgguggcacauacaggccagcacgaucuggucauacccccaaacggguauuuccgauucgacucgugggugaaucaauuuuacacccuugccccgaugggaaaggguacuggccgcagaagguga

SEQ ID NO: 20554 - RNA, 1617 nt, Artificial Sequence
  derived and/or modified sequence opt3 from VP1__Norovirus_and/or_Norovirus-like__AB663684
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagucuggcuaugucacaguggcccauaccgggcagcacgaucugguaauuccgccuaacggauacuuucgcuucgacuccugggugaaucaguucuauacucuugcacccauggguaacggcaccgggagaaggcgguga

SEQ ID NO: 20555 - RNA, 1617 nt, Artificial Sequence
  derived and/or modified sequence opt3 from VP1__Norovirus_and/or_Norovirus-like__KR904209
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccacaacuacaccaugaaucucgcaucucagaacuggaacuccuaugaucccacggaggaaauuccugcuccacuggguacucccgacuucguagggaagauccagggaguucuuacacagaccacucgggccgacggcucaacacgcggccauaaggcuaccguguacacggggagcgccgauuuuaguccuaagcugggacgaguccaauucgcaaccgacacaaauaaugauuuugacgccaaccagaauacuaaauucaccccagugggugucauccaggauggcgagacagcucacagaaacgaaccccaacaguggguguugccgucuuacuccgggaggaauauucacaacguucaucucgcgccugcaguggccccaacuuuucccggagagcagcuguuauucuuucggagcaccaugccuggcuguucggguuaucccaauauggaacuggacugccucauaccacaggaguggguacaauacuucuaucaggaggcugccccugcacagucugaugucgcccuucugcguuuugugaaccccgacacagggcgcguuuuguucgaauguaagcuacacaaauccggcuacgugaccgucgcucauacuggacagcacgaucuggugaucccaccgaacggcuauuuuagauucgacucauggguaaaucaauucuacacgcucgccccuauggggaacggaacagguaggcggcgauga

SEQ ID NO: 20556 - RNA, 1617 nt, Artificial Sequence
  derived and/or modified sequence opt3 from VP1__Norovirus_and/or_Norovirus-like__AB933716
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagguacccgccccucuugguacuccagauuucguugggaagauucagggagugcugacacagaccacuaagggcgacggcucuacacgcgggcacaaggcuaccgucuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguucucccgucuuacuccggaagagaugugccuaauguacaccuggcaccagccgucgcucccaccuuuccuggcgagcaguuacuguucuuuaggagcacuaugcccgguuguucgggguauccaaacauggaccucgauugccuucugccucaggagugggugcagcauuucuaccaagaagcggcacccgcccagucugacguugcuuugcuacgguuugugaauccagauacgggccguguccuguucgaguguaaacuccacaaguccggauaugugacaguagcccauaccggccagcacgaccuggugaucccgccuaacggguacuuucgcuucgauucauggguuaaccaguucuauacucuugcacccaugggaaaugguaccggcagaaggcgguga

SEQ ID NO: 20557 - RNA, 1617 nt, Artificial Sequence
  derived and/or modified sequence opt3 from VP1__Norovirus_and/or_Norovirus-like__AB933666
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaagacacaaaguucacuccagugggcgucauccaggaugggggaaccacacaccgaaaugaaccccagcaaugggugcucccgaguuacucuggcagaaacguuccuaaugugcaccuggcaccagccguagcucccaccuuuccuggugagcaguuacuguucuuuagguccacuaugcccggguguagcggcuauccaaacauggaccucgauugccuucugccucaggaguggguccagcauuucuaccaagaagcggcacccgcccagucggacguggcuuugcuacgguuuguuaauccagauacgggacgugugcuguucgaguguaaacuccacaagucuggcuaugucacaguggcccauaccgggcagcacgaccugguaauuccgccuaacggauacuuucgcuucgauuccugggugaaccaguucuauacucuugcacccauggguaauggcaccgggagaaggcgguga

SEQ ID NO: 20558 - RNA, 1617 nt, Artificial Sequence
  derived and/or modified sequence opt3 from VP1__Norovirus_and/or_Norovirus-like__EU921349
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguccggucaauauuugcaccuuucggggagacgugacacauaucgccggcacccaggaguacacgaugaaccucgcaagccagaauuggaacaauuaugaucccacugaagagauuccugcuccacuggguacacccgacuucguagggaagauccagggaguucuuacccaaacuacacgccgagacggcucuaccagaggccacaaagccacgguguccaccgggucaguccauuuuacaccuaagcugggaaggauccaguucagcacugauaccaguaacgacuuugaaacaggucagaauacucgguucaccccagugggcgucgugcaagaugggucuacaacccaccagaacgagccccagcaguggguuuugccggacuacuccggacgugauagccacaaugugcaucucgcuccugccguagcaccaucguuucccggcgaacaacuguuauucuuucgcucuacuaugccugguuguuccggguaccccaacaugaaucuggacugccuccuuccacaggaguggguccagcacuucuaucaggaggccgcuccugcgcaaucagauguggcacuguugagauuuguuaaccccgacacgggcagggugcuauucgaauguaagcugcauaaaaguggauacgucacaguggcccacaccggccagcacgaucucguaauuccaccgaauggguauuuucgguucgacagcugggugaaccaguucuacacucuggcuccuaugggaaacgguaccggccgacgcagauga

SEQ ID NO: 20559 - RNA, 1617 nt, Artificial Sequence
  derived and/or modified sequence opt3 from VP1__Norovirus_and/or_Norovirus-like__EU921348
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguccggucaauauuugcaccuuucggggagacgugacacauaucgccggcacccaggaguacacgaugaaccucgcaagccagaauuggaacaauuaugaucccacugaagagauuccugcuccacuggguacacccgacuucguagggaagauccagggaguucuuacccaaacuacacgccgagacggcucuaccagaggccacaaagccacgguguccaccgggucagucaacuuuacaccuaagcugggaaggauccaguucagcacugauaccaguaaugacuuugaaacaggucagaacacucgguucaccccagugggcgucgugcaagaugggucuacaacccaucagaaugagccccagcaguggguuuugccggacuacuccggacgugauagccacaacgugcaccucgcuccugccguagcaccaucguuucccggcgaacaacuguuauucuuucgcucuacuaugccugguuguuccggguaccccaauaugaaccuggacugccuccuuccacaggaguggguccagcauuucuaucaggaggccgcuccugcgcaaucagauguggcacuguugagauuuguuaaucccgacacgggcagggugcuauucgaauguaagcugcacaaaaguggauacgucacaguggcccauaccggccagcacgaucucguaauuccaccgaacggguauuuucgguucgacagcugggugaaccaguucuacacucuggcuccuaugggaaaugguaccggccgacgcagauga

SEQ ID NO: 20560 - RNA, 1617 nt, Artificial Sequence
  derived and/or modified sequence opt3 from VP1__Norovirus_and/or_Norovirus-like__EU921345
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguccggucaauauuugcaccuuucggggagacgugacacauaucgccggcacccaggaguacacgaugaaccucgcaagccagaauuggaacaauuaugaucccacugaagagauuccugcuccacuggguacacccgacuucguagggaagauccagggaguucuuacccaaacuacacgccgagacggcucuaccagaggccacaaagccacgguguccaccgggucaguccauuuuacaccuaagcugggaaggauccaguucagcacugauaccaguaacgacuuugaaacaggucagaauacucgguucaccccagugggcgucgugcaagaugggucuacaacccaccagaacgagccccagcaguggguuuugccggacuacuccggacgugauggccacaaugugcaucucgcuccugccguagcacccagcuuuccaggugaacaacuguuauucuuucgcucgacuaugccuggguguucuggcuaccccaacaugaaucuggacugccuccuuccacaggaguggguccagcacuucuaucaggaggccgcuccugcgcaauccgauguggcacuguugagauuuguuaaccccgacacgggaagggugcuauucgaauguaagcugcauaaaucaggcuacgucacaguggcccacaccgggcagcacgaucucguaauuccaccgaauggauauuuucgguucgacaguugggugaaccaguucuacacucuggcuccuauggguaacggcaccgggcgacgcagauga

SEQ ID NO: 20561 - RNA, 1617 nt, Artificial Sequence
  derived and/or modified sequence opt3 from VP1__Norovirus_and/or_Norovirus-like__KP698924
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguauucccgacuucgucgggaagauccagggagugcuuacucagacaacccggacugacggcucaacacgcggccauaaggccaccgucuacacggggagcgcugauuuugccccuaagcugggacgagugcaauucgagaccgacacaaaccacgauuuugaagcaaaucagaacacuaaauucaccccaguuggugugauucaggacggcgggacaacucacagaaaugagccccaacaguggguauugccgaguuacucuggaaggaacaccccuaauguccaucucgccccagcuguggcgcccacauuuccuggcgaacagcuguuauucuuucgguccaccaugcccgguuguagcggguauccaaacauggaucuggacugccuccuuccucaggaguggguucaacacuucuaccaggaggcagcccccgcucagucggauguggcccuguugcguuuugucaauccagacacuggccgcgugcuauucgaauguaagcugcauaaaucuggauauguaacgguggcacacacaggccagcacgaucucguuaucccgccuaacggguacuuuagauucgacuccugggucaaccaauucuauacccuggcccccaugggaaaugguacuggcaggcggcgauga

SEQ ID NO: 20562 - RNA, 1617 nt, Artificial Sequence
  derived and/or modified sequence opt3 from VP1__Norovirus_and/or_Norovirus-like__LC005707
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgacuuuacccccaaauuggguuccguccaguucucaacagauacugaaaaugacuuugagacccaucaaaacacaaaguucacuccugugggcgucauccaggaugggagcaccacacaccgaaaugaaccacagcaaugggugcuccccaguuacucuggaagaaacguucacaaugugcaucuggcuccggcgguagcaccuaccuuuccaggcgagcaguuacuguucuuuagguccacuaugcccgguuguagcggguauccuaacauggaccucgauugccuucugccccaggaguggguccagcacuucuaccaagaagccgcuccagcccagucggacguggcauugcuacgguuuguuaauccugaucagggccgugugcuguucgaguguaaacuccauaagucuggauaugucacgguggcccacacaggccagcacgaccugguaauucccccaaacggguacuuucgcuucgauuccugggugaaccaauucuauacccuugcuccgaugggaaaugguacuggcagaaggcgguga

SEQ ID NO: 20563 - RNA, 1617 nt, Artificial Sequence
  derived and/or modified sequence opt3 from VP1__Norovirus_and/or_Norovirus-like__KJ541743
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuaugucacaguggcccacaccgggcagcacgaucugguaauuccaccgaacggauacuuucgcuucgacuccugggugaaucaguucuauacucuugcaccuauggguaacggcaccgggagaaggcgguga

SEQ ID NO: 20564 - RNA, 1617 nt, Artificial Sequence
  derived and/or modified sequence opt3 from VP1__Norovirus_and/or_Norovirus-like__KF177443
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgguacagacacugaucaugacuuugaggcaaaucagaacaccaaauucacaccaguuggcgugauccaggaugggagcacuacccacaggaaugaaccccaacaguggguauugccgaguuacucuggacggaacacaccuaauguccaccucgccccagcuguggcgcccaccuuuccuggcgagcagcuguuauucuuucguuccacuaugcccgguuguagcggguauccaaacauggaccuggauugccuccuuccucaggaauggguucaauacuucuaucaggaggcagcccccgcucagucggacguggcccuguugcgcuuugucaauccagauacgggcagagugcuauucgaguguaagcugcauaaaucuggauacguaacaguggcacacaccggccagcaugaccucguuauuccgccuaacggguauuuuagguucgauuccugggucaaccaauucuacacucuggcccccaugggaaaugguaccggccggcgacgcuga

SEQ ID NO: 20565 - RNA, 1617 nt, Artificial Sequence
  derived and/or modified sequence opt3 from VP1__Norovirus_and/or_Norovirus-like__JX439842
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggguauacaccaugaaccucgcuucucugaauuggaacaauuaugacccgacggaagagauucccgccccucuugguacuccagauuucguugggaagauccagggagugcugacacagaccacuaaggaagacggcuccacacgcggccacaaggcuaccgucuacacggggucagcccccuuuaccccuaaauugggaagcgugcaguucaguacagacacugagaacgauuuugaaacccaucaaaauacaaaguucacuccagucggugugauccaggacggcgggaccacacaccgaaacgagccccagcaauggguucucccgucuuacuccggaagaaaugcaccuaacgugcaccuggccccagcuguagcgcccaccuuuccuggcgagcaguuacuguucuuuaggagcacuaugcccgguuguucgggguauccaaauauggaucucgacugccuucugccucaggaauggguccagcauuucuaccaagaggcagcccccgcucagucugauguggccuugcuacgguuuguuaacccagacacgggccgugugcuguucgaauguaaacuccacaaguccggauaugucacaguggcacauaccggccagcacgaucugguaauuccgccuaauggguacuuucgcuucgacucaugggugaaccaguucuauacucuugcccccaugggaaacgguaccggcagaaggcgguga

SEQ ID NO: 20566 - RNA, 1617 nt, Artificial Sequence
  derived and/or modified sequence opt3 from VP1__Norovirus_and/or_Norovirus-like__HF952135
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauuucuggcucccggaauuacaccaugaaccucgccgcacagaauuggaacucauaugaucccacggaggaaaucccugcuccacuggguacucccgacuucguugggaagauucagggagugcuuacacagaccacuaagacaaauggcagcacccgcggccacaaggccacggucuacaccgggagugcugacuuuucuccuaaacugggacgagugcaauucgccacagauacugacaacgauuuugagaccaaucagaacacaaaguucacuccagucggugugauccaggacggcuccaccacacccagaaaugaaccgcaacaguggguuuugccuagcuacucggggaggaacacccauaaugugcaccucgcaccagccguagcucccacuuuuccuggagagcagcuguuauucuuucggucuacgaugcccggcuguuccgguuauccaaacauggaucuggacugccuccuuccucaggaauggguccaauacuucuaucaggaggcggcacccgcccagucagauguggcucuguugcguuuuguuaauccagacacagggcgcgugcuauucgaguguaaacugcacaagaguggcuacgucaccguggcccauacuggacagcacgaucucguaaucccgccuaacggcuauuuuagauucgacagcugggugaaccaauucuacacccuggcacccauggggaauggaacagguaggcggcgauga

SEQ ID NO: 20567 - RNA, 1617 nt, Artificial Sequence
  derived and/or modified sequence opt3 from VP1__Norovirus_and/or_Norovirus-like__JX459598
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggcacgccccucugggaccagauuugaaccccuacuuaagucaucuggcucggauguauaauggcuacgccgguggguucgaagugcaggucauucuagcgggaaacgcauuuacggccggcaaaaucauuuucgcugccgugccuccaaauuuuccgaccgagggccucagccccucccagguaacaauguucccucacaucauaguugacgugcgccaacuggagccaguccuuaucccccugccugaugugcgaaacaauuuuuaucauuacaaccagucuaaugacccaacuauuaaguugaucgcaaugcucuauacgccccugcgugcuaacaacgccggggaugacguguucacagucucgugcagaguucugaccaggccgucaccugauuuugacuucauuuuucucgugcccccaacuguagaaagccggacaaaaccuuucagugugcccaucuuaaccgucgaggaaaugaccaauucccgcuuuccaauaccccuggagaaacuuuucacuggaccuucuagcgcguucgugguucagccacagaacgguagauguaccacagauggcguguugcuggggacuacccaacuauccccggucaauauuugcacauuuaggggagacgugacccacaucgccggcacgcagaacuacacuaugaaucucgcaucacagaacuggaauaacuaugaucccacagaggaaauuccugcuccacuggguacccccgacuucguagggaagauccagggaguucuuacucaaacaacccggcgcgacggcaguacgcgaggccauaaggccaccgugagcacagggucuauccacuuuacuccuaagcugggauccguccaguucucaaccgauacaagcaaugacuuugagacuggucagaacaccagauucacaccagugggcgucgugcaagaugggaguaccacucaccagaaugaaccccagcaguggguuuugccgaacuacucuggaagggacucccauaaugugcaccucgcuccugccguagcaccaacguuucccggcgagcaacuguuauucuuucggagcacaaugccugguuguucgggguaccccaacaugaaucuggauugccuccuuccacaggaauggguccagcauuucuaucaggagucugccccugcucaauccgacguggcgcuguugcguuuuguuaaccccgauaccggccgcgugcuauucgaguguaaacugcacaagucaggauacgucacuguggcacacaccggccagcaugaccucguaauuccaccgaacggguauuuuagauucgauaguugggugaaucaguucuacacacuggccccuaugggaaacggugcuggcaggcggcgauga

SEQ ID NO: 20568 - RNA, 1617 nt, Artificial Sequence
  derived and/or modified sequence opt3 from VP1__Norovirus_and/or_Norovirus-like__JX445162
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguucagaacgugcaccuggccccugcaguagcuccaaccuuucccggugagcaguuacuguucuuuagguccacuaugccuggguguagcggcuaucccaauauggaucucgacugccuucugccacaggaguggguccaacauuucuaccaggaagcggccccugcacagucggauguggcuuugcuacgguuuguuaaccccgacacgggacgugugcuguucgaguguaaacuccacaagucuggcuaugucacaguggcccauaccgggcagcacgaucugauuauaccaccgaacggauacuuucgcuucgacuccuggguaaaucaauucuauacucuugcaccuauggguaacggcaccgggagaaggcgguga

SEQ ID NO: 20569 - RNA, 1617 nt, Artificial Sequence
  derived and/or modified sequence opt3 from VP1__Norovirus_and/or_Norovirus-like__JX445154
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccagauucacaccagucggcgugguucaagaugggucuaccacucaccagaaugaaccccagcaguggguguugccggacuacuccggaagggauagccacaacguacaucucgcuccugccgucgcaccaacguuucccggcgagcaacuguuauucuuucggucgacaaugccugguuguucuggguaccccaauaugaaccuggacugccuccuuccacaggaaugggugcagcacuucuaucaggaguccgccccugcucaaucagauguugcgcuguugcguuuugugaaucccgacaccggccgcguccuauucgaguguaaacugcauaagccaggauacgugacuguagcacacaccggccagcacgaucucgugaucccgccuaacggguauuuuagauucgacaguuggguuaaccaguucuacacacuggcccccaugggaaauggugcuggcaggcggcgauga

SEQ ID NO: 20570 - RNA, 1617 nt, Artificial Sequence
  derived and/or modified sequence opt3 from VP1__Norovirus_and/or_Norovirus-like__JX155752
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucacaauuacgcuaugaaccucgccagccugaauuggaacaauuaugacccgaccgaagagauucccgcuccucuugguacgccagauuucguagggaagauccagggaguucugacucagacaaccaagggcgacggcucuacucgggggcauaaggccacaaucuacaccggauccgcacccuuuacgccuaaauuggguucagugcaguucagcaccgacacagaaaacgauuuugagacucaccaaaauaccaaguucacaccagucggcgugauucaggacgggggaacuacccaccgcaacgaaccccagcaauggguccucccgaguuacucuggccgaaaugugccuaacguucaucuggccccagcuguggcgcccacauuuccuggugagcaguuacuguucuuuagauccaccaugcccggguguagcggcuauccaaauauggaucucgacugccuucugccucaggaguggguacagcacuucuaccaagaagcagcccccgcucagucggaugucgccuugcuaagguuugugaacccagacacuggacggguucuguucgaguguaaacuccauaagucuggcuaucugacgguggcacacacagggcagcacgaucuugucauaccgccuaacggauacuuucguuucgacuccugggugaaucaguucuauacccuggcccccauggguaacggcacugggcgcagaagguga

SEQ ID NO: 20571 - RNA, 1617 nt, Artificial Sequence
  derived and/or modified sequence opt3 from VP1__Norovirus_and/or_Norovirus-like__HM748971
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggcacucccgucuuacuccggcagaaacgugcagaauguucaccuggccccugcuguggcgccaaccuuucccggugagcaguuacuguucuuuaggagcacuaugccuggguguucgggcuaucccaacauggaucucgacugccuucugccacaggaguggguacaacauuucuaccaggaagcagccccugcucagucugaugucgccuugcuacgguuugugaaucccgacacgggacguguucuguucgaguguaaacuccacaaguccggcuaugugacagucgcacauaccgggcagcacgaucuggugauuccaccgaacggauacuuucgcuucgacucauggguaaaccaauucuauacucuugccccuauggguaauggcaccgggagaaggcgguga

SEQ ID NO: 20572 - RNA, 1617 nt, Artificial Sequence
  derived and/or modified sequence opt3 from VP1__Norovirus_and/or_Norovirus-like__GQ845367
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauaugaaccccuacuugucccacuuagcucggauguauaauggcuacgccgguggguucgaagugcaggucauucuggcgggaaacgcauuuacugccggcaaaaucauuuucgcugccgugccuccaaauuuuccgacggagggccuaucucccucgcagguaaccauguucccucauaucauaguugacgugcgccaacucgagccaguccugaucccccuuccugaugugcgaaacaauuuuuaucacuacaaccagucaaaugacccaacaauuaagcugaucgcaauguuguauacuccccuccgugcuaacaacgccggggaugacguguucaccgucagcugcagaguucugacaaggccgaguccugauuuugacuucauuuuucuggugcccccaaccguagaaucccggacuaaaccuuucucugugcccauccucacagucgaggaaaugaccaauagccgcuuuccaauacccuuagagaagcuguucacgggaccuuccucagcguucgugguucagccacagaacgguagauguacuaccgauggcgugcuuuuggggacaacucaacugaguccggucaauauuugcaccuuuaggggagacgugacacauaucgccggcagccggaacuacaccaugaaucuagcaucucagaacuggaacuccuaugaucccacggaggaaauuccugcuccacucgguacucccgacuucguagggaaaauccagggaguucugacacagaccacucgcacagacggcucaacccgaggccacaaggccacgguguacaccgggagcgcugauuuuaguccuaaacuuggaagaguccaauucgccacagacacugauaaugacuuugaugcaaaucagaacaccaaguucacaccagugggugucauccaggacggcaauacugcccauaggaacgagccccaacagugggugcugccgucuuacuccgggcggaauacccacaacguucacuuggcuccugcgguggcaccaacauuucccggagaacagcuccuguucuuucguagcaccaugccuggcuguucggguuaucccaauauggauuuagacugccugcucccacaggaguggguacaauacuucuaucaggaagccgcuccugcccagucugaugucgcacuucugcgcuuugugaaccccgacacugggagaguuuuguucgaguguaagcuacauaaauccggcuacgugacggucgcccacacaggacagcaugaucuggugauuccaccgaacggcuauuuuagguucgacucauggguaaaucaauucuacacccucgcuccuauggggaacggaacuggucggcgacgcuga

SEQ ID NO: 20573 - RNA, 1617 nt, Artificial Sequence
  derived and/or modified sequence opt3 from VP1__Norovirus_and/or_Norovirus-like__GQ856455
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagccaaacgacucgaccauuaaguugaucgcuaugcucuauacaccccugcgugccaacaaugcgggggaagauguguucacugucucaugcagaguucugaccaggccgagcccugacuuugauuucauuuuucucgugcccccaacaguagagagucggaccaaaccuuucacugugcccaucuuaacagucgaagagaugaccaacucccgcuuuccaauaccccuggagaaacuuuucacgggaccuucuagcgccuucgugguucagccacagaaugguagauguacuaccgacggcguguugcuggggacaacucaacuauccccggucaacauuugcaccuuuaggggagaugugacacauaucgcaggcucacggaauuacaccaugaaccucgcuagucugaauuggaacaauuaugaccccacggaagagauuccugccccacuugguacucccgauuucguagggaagauccagggaguucugacacagaccacuaagggcgacggcagcacacacgggcauaaggcuaccguguacacgggaucugccccuuuuaccccaaaauuggguuccguccaguucucaacagacacugaaaacgauuuugagacccaccaaaauacaaaguucacucccgugggcgucauccaggacgggagcaccacacaccgcaacgaaccgcagcaaugggugcucccuaguuacucuggacgaaauguucagaacgugcaucuggcaccagccguagcucccaccuuuccuggcgagcaguuacuguucuuuagauccacuaugcccgguuguagcggguauccaaauauggaucucgacugccuucugccucaggaguggguccaacacuucuaccaggaagcggcacccgcccagucggauguggcuuugcuaagguuuguuaacccagacacgggccgggugcuguucgaguguaaacuccauaagucuggauaugucacaguggcccacaccggccagcacgaucugguaauuccgccuaacggguacuuucguuucgacuccugggugaaucaauucuauacucuugcacccaugggaaacgguaccggccgcagaagguga

SEQ ID NO: 20574 - RNA, 1617 nt, Artificial Sequence
  derived and/or modified sequence opt3 from VP1__Norovirus_and/or_Norovirus-like__GQ856447
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccaacuuaagccaccuggcccggauguacaauggcuaugcggguggguucgaagugcaggucauucuagcaggaaacgccuuuacagcuggcaaaaucauuuucgccgcagugccuccaaauuuuccgacugagggccucucccccucucagguaacgauguucccucauaucauaguugacgugcgccaacuggagccaguccuuaucccccugccugaugugcgaaacaauuuuuaccacuauaaccagucgaacgacucaaccauuaaguugaucgcuaugcucuacacaccacugcgugccaauaacgcgggggaagauguguucacugucagcugcagaguucugaccaggcccaguccggacuuugauuucauuuuucucgugccucccacaguagagucccggaccaaaccauucacugugccuaucuuaacagucgaagagaugaccaauucucgcuuucccauaccacuggagaaacuuuucacgggacccagcuccgccuucgugguucagccucagaacgguagauguacuaccgacggcguguugcuggggacaacucaacuaucaccagucaauauuugcaccuuuaggggagaugugacacauaucgcaggcagucggaacuauaccaugaaucucgcuagccugaacuggaauaacuacgacccgacggaagagauucccgccccucuugguacuccagauuucguagggaagauccagggaguucugacacagaccacuaagggcgacggcucuacacgcgggcacaaggcuaccguguauacgggauccgcccccuuuaccccuaaauuggguucaguccaguucagcacagacacugaaaaugauuuugagacccaucaaaacacaaaguucacuccagugggcgucauccaggacgggggaaccacacaccgaaaugaaccccagcaaugggugcucccgaguuacucuggcagaaacguucagaaugugcaccuggccccugcaguagcuccaaccuuucccggugagcaguuacuguucuuuagguccacuaugccuggguguagcggcuaccccaacauggaucucgacugccuucugccacaggaguggguccaacauuucuaucaggaagcggccccugcacagucggauguggcuuugcuacgguuuguuaaccccgacacgggacgugugcuguucgaguguaaacuccacaagucuggcuacgucacaguggcccauaccgggcagcacgaucugguaauuccaccgaauggauauuuucgcuucgacuccugggugaaccaauucuacacucuugcaccuauggguaauggcaccgggagaaggcgguga

SEQ ID NO: 20575 - RNA, 1617 nt, Artificial Sequence
  derived and/or modified sequence opt3 from VP1__Norovirus_and/or_Norovirus-like__AB541318
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcaauaccgcucauaggaacgagccccaacaguggguguugccgagcuacagugggcguaauucucacaacguucaccucgcgccugcaguggccccaacauuucccggagaacagcuguuauucuuucgguccaccaugccuggcuguagcgguuaucccaauauggaucuggacugccuccuuccacaggaguggguacaauacuucuaucaggaagcugccccugcacagucggaugucgcccuguugcgcuuugugaaccccgacacugggagaguucuauucgaguguaagcugcauaaaucuggcuacgugacggucgcucacacaggacagcaugaucucgugauuccaccgaacggcuauuuuagguucgacuccuggguaaaucaauucuacacccuggccccuauggggaacggaacuggucggcgacgcuga

SEQ ID NO: 20576 - RNA, 1617 nt, Artificial Sequence
  derived and/or modified sequence opt3 from VP1__Norovirus_and/or_Norovirus-like__AB541307
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagccgggcuaugucacaguggcccauaccgggcagcacgaucugguaauuccuucuaacggauacuuucgcuucgacuccugggugaaucaguucuauacucuugcacccauggguaacggcaccgggagaaggcgguga

SEQ ID NO: 20577 - RNA, 1617 nt, Artificial Sequence
  derived and/or modified sequence opt3 from VP1__Norovirus_and/or_Norovirus-like__AB541254
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugaaagcaccugguggcgaauuuaccguuucaccaaggaacagucccggggagauccuuuggagcgccccucugggaccagauuugaaucccuacuuaucccaccuggcucggauguauaacggcuacgccgguggguucgaagugcaggucauucuagcgggaaaugcauuuacagccggcaagaucauuuucgcugccgugccuccaaacuuuccgacugagggccucucucccucgcagguaacgauguucccucauaucauaguugacgugcgccagcuggagccaguccuuaucccccugccugaugugcgaaauaacuuuuaucacuacaaucaaucaaacgacagcaccauuaaauugaucgcaaugcucuauacaccacugcgugcuaacaaugccggggaugacguguucacugucaguugcagaguucugaccaggcccuccccggauuuugacuucauuuuucucgugccucccacaguagaaucucggaccaagccauucacugugccuaucuuaacagucgaggaaaugaccaacagccgcuuucccauaccacuggagaaacuuuucacgggacccuccucagcguucauugugcagccucagaaugguagauguacuaccgauggcguuuugcuggggacaacucagcuaaguccagugaacaucugcaccuuuaggggagacgucacacauauugccggcagccggaauuacaccaugaaccucgcaucucugaauuggaacaauuaugauccgacggaggaagugcccgcuccucuugguacuccagacuucguagggaagauccaaggaguucugacacagaccacuaagggcgacggcuccacacgcgggcacaaagccaccguguacacgggaucagcugauuuuacccccaaguuggguagcguccaguucggcacagacacugagaacgauuuugaaacccaucagaauacaaaauucacuccugugggggucauccaagacggaaguaccacacaccgaaacgagccacagcagugggugcuccccucuuacuccggcagaaauguucacaacgugcaucuggccccggcaguagccccuaauuuuccaggugaacaauuacuguucuuuaggagcaccaugcccggguguucgggcuauccuaacauggaucucgacugccuucugccccaggaguggguccagcacuucuaccaggaggcugcgccagcacaaucugauguggccuugcuacgguuuguuaacccugacacuggacgugugcuguucgaauguaagcuccauaaauccggcuaugucacgguggcucacacagggcagcacgaucugguaauucccccaaauggauacuuucgcuucgacucaugggugaaccaguucuauacccuugccccgauggguaauggcacugggagaaggcgguga

SEQ ID NO: 20578 - RNA, 1617 nt, Artificial Sequence
  derived and/or modified sequence opt3 from VP1__Norovirus_and/or_Norovirus-like__AB541243
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagaucccuuggagugcuccacuuggacccgaucugaauccuuacuugagccacuuagcccggauguauaacggcuacgcggguggguucgaagugcaggucauucuggcaggaaaugccuuuacagcuggcaaaaucauuuucgccgcagugccaccgaacuuucccacugagggccuauccccuucucagguaacgauguucccacauaucauaguugacgugcgccaacucgagcccguccugaucccucuuccagaugugcgaaauaacuuuuaucacuacaaucagucgaacgacucaaccauuaagcugaucgcuauguuguauacaccccuccgugccaacaaugcgggggaagauguguucacugucagcugcagaguucugaccaggccgaguccugacuuugauuucauuuuucuggugcccccaacaguagagucccggaccaaaccuuucacugugcccauccucacagucgaagagaugaccaacucucgcuuuccaauacccuuagagaagcuguucacgggaccuagcuccgccuucgugguucagccacagaaugguagauguacuaccgacggcgugcuuuuggggacaacucaacugucaccggucaacauuugcaccuuuaggggagaugugacacauaucgcaggcagucgggacuacaccaugaaucuagcuagccucaacuggaauaacuaugaucccacggaagagauuccugccccacuggguacucccgacuucguagggaaaauccagggaguucuuacacagaccacuaagggcgacggcucuacacgcgggcacaaggcuaccguguacacgggauccgccccuuuuaccccaaaacuggguucaguccgauucagcacagauacugaaaaugacuuugagacccaucagaacacaaaguucacucccgugggcgucauccaagaugggaguaccacacacagaaaugaaccgcagcaguggguguugccuucuuacuccggaagggacguucacaacgugcaucucgcaccagccguagcucccaccuuuccuggcgagcaacuguuauucuuucggagcacuaugcccgguuguucgggguauccaaauauggaucuggacugccuccuuccucaggaguggguccagcacuucuaccaggaagcggcacccgcccaaucugauguggcucuguugcguuuuguuaacccagacacgggccgcgugcuauucgaguguaaacugcauaaguccggauaugucacaguggcccacaccggccagcacgaucucguaauuccgccuaauggguacuuuagauucgacucaugggugaaccaguucuauacucuggcacccaugggaaacgguaccggcaggcggcgauga

SEQ ID NO: 20579 - RNA, 1617 nt, Artificial Sequence
  derived and/or modified sequence opt3 from VP1__Norovirus_and/or_Norovirus-like__AB541232
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacgggacuacaccaugaaucucgcuagucugaacuggaauaacuaugauccgacggaagagauucccgccccucuugggacuccagacuucguaggaaagauccagggcguucugacacagaccacuaagggcgacgggagcacacgcggacacaaggcuaccguguacacggguucuacccccuuuacaccuaaauugggcuccguccaguucucaacugauaccgaaaaugacuuugagacacaucaaaacacuaaguucaccccagugggggucauccaggauggaagcacaacccaccgaaaugaaccccagcaaugggugcucccgaguuacucuggcagaaacguucagaaugugcaccuggccccugcaguagccccaacuuuucccggugagcaguuacuguucuuuagguccacgaugccuggguguagcggcuaucccaacauggaccucgauugccuucugccacaggaguggguccaacauuucuaccaggaagcugcgccugcacagucggacguggccuugcuacgguuuguuaaucccgauacaggacgugugcuguucgaguguaaacuccacaagucuggcuaugucaccguggcucauacugggcagcacgaccugguaauuccaccgaacggauacuuucgcuucgauuccugggugaaccaauucuauacccuugccccuauggguaauggcacagggagaaggcgguga

SEQ ID NO: 20580 - RNA, 1617 nt, Artificial Sequence
  derived and/or modified sequence opt3 from VP1__Norovirus_and/or_Norovirus-like__GQ246800
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucccgugccaccuaccguagaaagucggacuaaacccuucacagugccaauccucaccgucgaggaaaugacgaacucccgcuuucccauaccuuuagagagacuguacacuggaccaucuagcgcguucgugguucagccgcagaaugguagguguaccacagauggcgugcuuuuggggacuacccaacuguccgccgucaacauuugcacauuccggggagacgugacccauaucgcaggcucacgcaauuauacgaugaaccuagcuagucagaauuggaacaauuacgaucccacugaggaaauuccugccccacucgguacacccgacuuuguagggaagauccagggaaugcugacccagacuacacgaagcgacggcucuaccagaggccacaaagcuacgguucuuaccggguccgccgauuucgcaccuaagcugggaagggugcaauuugccacagacacugauaacgacuucgagucaggucagaauaccaaguuuacaccagucggcgugauccaggaugggagcacuacccaucggaacgaaccccaacagugggucuugccgaauuacaguggacguacaggccacaacgugcaccucgcuccugcgguugcaccaaccuaucccggugagcagcuguuauucuuucgcucuacuaugccuggguguuccggcuaccccaauauggaccuggauugccuccuuccacaggaaugggugcaacauuucuaucaggaggccgcuccugcccagagcgacguagcacuguugagauuugucaaccccgauacgggaagggugcuauucgaguguaaacugcacaagucgggcuacguuacaguggcccauaccgggcagcacgaccucgucauuccaccgaacggauauuuucgguucgauucuugggugaaucaauuuuacacucuggcuccuauggguaacggcaccgggcgacgcagauga

SEQ ID NO: 20581 - RNA, 1617 nt, Artificial Sequence
  derived and/or modified sequence opt3 from VP1__Norovirus_and/or_Norovirus-like__GU390900
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgucagacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguucagaaugugcaccuggccccugcaguagcuccaaccuuucccggugagcaguuacuguucuuuaggagcacuaugccuggguguucgggcuaucccaacauggaucucgacugccuucugccacaggaguggguccaacauuucuaccaggaagcggccccugcacagucugauguggcuuugcuacgguuuguuaaucccgacacgggacgugugcuguucgaguguaaacuccacaaguccggcuaugucacaguggcccauaccgggcagcacgaucugguaauuccaccgaacggauacuuucgcuucgacucaugggugaaccaauucuauacucuugcaccuauggguaauggcaccgggagaaggcgguga

SEQ ID NO: 20582 - RNA, 1617 nt, Artificial Sequence
  derived and/or modified sequence opt3 from VP1__Norovirus_and/or_Norovirus-like__AB504328
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucacgagucugaauuggaacaauuaugacccgacugaagagauucccgcuccucuugggacaccagauuucguaggaaaaauccagggccuguugacccagacuacaaagggcgacgggagcacccgcggacacaaggccacgguuuacaccgguucugcucccuuuacaccuaaacucggcuccgugcaguucucaacugacaccgaaaacgauuuugagacacaucaaaauacuaaguucaccccagucggggugauccaggacggaagcacaacccaccgaaacgaaccccagcaauggguccugccgaguuacucuggcauuaaugugcacaacguucauuuagccccugcaguggccccaacuuuucccggugagcagcuucucuucuuuagauccacgaugccuggguguagcggcuaucccaauauggaucuugacugccuguugccacaggaguggguacagcacuucuaccaagaagcugcgccugcacagucggaugucgcccuacugagguuugugaaccccgacacaggacggguucucuucgaguguaaacugcauaagucuggcuaugugaccgucgcucacacugggcagcacgaucuugugauaccaccgaacggauacuuucguuucgacuccuggguaaaucaguucuauacccuggccccuauggguaacggcacagggcgcagaagguga

SEQ ID NO: 20583 - RNA, 1617 nt, Artificial Sequence
  derived and/or modified sequence opt3 from VP1__Norovirus_and/or_Norovirus-like__AB447434
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacuccuacgcgggcgguuucgaagugcaggucauucuagcagggaaugccuuuacagcuggaaaaaucauuuucgccgcagugccuccaaacuuuccgacugagggccucucucccucgcagguaacgauguucccucauaucauaguugacgugcgccaacuggagccaguccuuaucccccugccugaugugcgaaauaacuuuuaucacuacaaucagucaaacgacccaaccauuaaguugaucgcuaugcucuauacaccccugcgugccaacaaugcgggcgaagauguguucacugucagcugcagaguucugaccaggccgaguccugacuuugauuucauuuuucucgugcccccaacaguagagucccggaccaaaccuuucacugugcccaucuuaacagucgaagagaugaccaacucucgcuuuccaauaccccuggagaaacuuuucacggggccuagcggagccuucgugguucagccacagaaugguagauguacuaccgacggcguguugcuggggacaacucaacuauccccggucaacauuugcaccuuuaggggagaugugacacauaucgcaggcucacggaauuacaccaugaaccucgcuagucugaauuggaacaauuaugaccccacggaagagauuccugccccacuugguacucccgauuucguagggaagauccagggaguucugacacagaccacuaagggcgacggcagcacacgcgggcacaaggcuaccguguacacgggaucugccccuuuuaccccaaaauuggguuccguccaguucucaacagacacugaaaacgauuuugagacccaucaaaauacaaaguucacucccgugggcgucauccaggacgggagcaccacacaccgaaacgaaccgcagcaaugggugcucccuaguuacucuggaagaaauguucacaacgugcaucuggcaccagccguagcucccaccuuuccuggcgagcaguuacuguucuuuagguccacuaugcccgguuguagcggguauccaaauauggaucucgacugccuucugccucaggaguggguccagcacuucuaccaagaagcggcacccgcccagucggauguggcuuugcuacgguuuguuaacccagacacgggccgugugcuguucgaguguaaacuccauaagucuggauaugucacaguggcccacaccggccagcacgaucugguaauuccgccuaacggguacuuucgcuucgacuccugggugaaucaguucuauacucuugcacccaugggaaacgguaccggcagaaggcgguga

SEQ ID NO: 20584 - RNA, 1617 nt, Artificial Sequence
  derived and/or modified sequence opt3 from VP1__Norovirus_and/or_Norovirus-like__EU839591
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccgcggaguucugacacagaccacuaagggcgacggcucuacacgagggcacaaggcuaccguguacacgggauccgcccccuuuaccccuaaauuggguucaguccaguucagcacagacacugaaaacgauuuugagacccaucagaauacaaaguucacuccagugggcgucauccaagacgggggaaccacacacagaaacgaaccccagcagugggugcucccgaguuacucuggcaggaauguuccuaacgugcaccuggcaccagccguagcucccaccuuuccuggugagcaauuacuguucuuucgguccacuaugcccggguguagcggcuauccaaauauggaucucgacugccuucugccucaggaguggguccagcauuucuaccaggaagcggcacccgcccaaucggauguggcuuugcuacguuuuguuaacccagacacgggacgcgugcuguucgaguguaaacuccacaagucuggcuaugucacaguggcccauaccgggcagcacgaucugguaauuccgccuaacggauacuuuagauucgacuccugggugaaucaguucuauacucuugcacccauggguaacggcaccgggaggcggcgauga

SEQ ID NO: 20585 - RNA, 1617 nt, Artificial Sequence
  derived and/or modified sequence opt3 from VP1__Norovirus_and/or_Norovirus-like__AB291542
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggccaugcggguggguucgaagugcaggucauucuagcaggaaaugccuuuacugcuggcaaaaucauuuucgccgcagugccuccaaacuuuccgacggagggccucucccccucucagguaaccauguucccucacaucauaguugacgugcgccagcuggagccaguccuuaucccccugccugaugugcgaaauaacuuuuaccauuauaaucaaucgaacgacucaacaauuaaguugaucgcuaugcucuacacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccacaucgcagguucacggaauuauacgaugaaccucgcuagucugaauuggaacaauuacgacccgacugaagagauucccgccccucuugggacaccagauuucguaggaaagauccaaggcguucugacccagacuacaaagggcgacgggagcacccgcggacauaaggcuacgguguauaccgguucugcccccuuuacaccuaaauugggcuccguccaguucucaacugacaccgaaaacgauuuugagacacaccagaauacuaaguucaccccagugggggucauccaagacggaagcacaacccaccgaaacgaaccccagcagugggugcucccgaguuacucuggcagaaauguucauaacgugcaccuggccccugcaguagcuccaacuuuucccggugagcaauuacuguucuuuagguccacgaugccuggguguagcggcuaccccaauauggaucucgacugccuucugccacaggaguggguccagcauuucuaucaggaagcggccccugcacaaucggauguggcuuugcuacgguuuguuaaccccgacacaggacgugugcuguucgaguguaaacuccacaagucuggcuacgucaccguggcccacacugggcagcaugaucugguaauuccaccgaacggauauuuucgcuucgacuccugggugaaucaguucuacacccuugcaccuauggguaacggcacagggagaaggcgguga

SEQ ID NO: 20586 - RNA, 1617 nt, Artificial Sequence
  derived and/or modified sequence opt3 from VP1__Norovirus_and/or_Norovirus-like__KX354123
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagagacuuuucaccggaccuuccucagccuucgucgugcagccacagaacgguagguguacgacugauggcguauugcuggggaccacacaacuaaguccgguuaauauuugcacuuuucggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccauaaagccacgcuguacaccgggucagcugaguuugccccuaaguugggaagaguccaauucgaaacagauacuaaucacgacuuugaggcaaaccagaauaccaaguucacaccaguggguguuauccaggauggcagcacuacccacaggaacgaaccccaacagugggugcucccgacauacagugggcggaauacccauaacguacaccuggccccugcugucgcgccaacuuuucccggagagcaguuacuguucuuucguucuacgaugccuggcuguuccgguuaucccaauauggaccucgauugccuucugccacaggagugggugcaacauuucuaccaggaagcagccccugcucagagcgacguugccuugcuacgcuuugugaaccccgauacagggagaguccuguucgaguguaaacuccacaagucgggcuauauuaccguggcacacacuggacagcaugaccugguaaucccaccgaacggcuacuuuagguucgauucuugggugaaucaauucuauacccuugccccuauggggaacggaacaggucggcgacgcuga

SEQ ID NO: 20587 - RNA, 1617 nt, Artificial Sequence
  derived and/or modified sequence opt3 from VP1__Norovirus_and/or_Norovirus-like__KX354050
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcgggugggcuagaagugcaggucauucucgcaggaaacgccuucacagcuggcaaaaucauuuuugccgcagugccuccaaauuucccgacugagggccugucucccucgcagguaacgauguuuccucauaucauaguugacgugcgccaacuugagccaguccugauccccuugccugaugugcgaaacaauuucuaucacuacaaccagucaaaugacccaaccauuaagcucaucgcuaugcuguauacaccccugcgugccaacaacgcgggggaugacguguuuacugucagcugcagaguucucaccaggccgaguccugauuucgacuuuauuuucuuagugcccccaacaguagaaucccggaccaaaccuuuuucugugcccauccugacugucgaggaaaugacaaauagccgcuucccaauaccccuugagaaguuguuuaccggaccuuccucagccuucgugguucagccacagaacgguagauguacgacugauggcgugcugcuagggaccacacaacucaguccggucaauauuugcacuuucaggggagacgugacccauaucacaggcagccggaacuacaccaugaaucuggcaucucagaacuggaauaacuaugaucccacggaggaaauuccugcuccacuugguacucccgacuuuguagggaaaauccagggaguucugacacagaccacucgcgccgacggcuccacacgaggccacaaggcuaccguguacacggggucagccgauuucgcaccuaaguugggaagaguccaauuugagaccgacacagaucaugacuucgaagccaaucagaacacuaaauuuaccccagugggugucauccaggauggcgggacaacucacaggaaugagccccaacagugggugcucccgagcuacaguggacggaacacccacaauguucaucuggcuccugcgguggcaccaacauuccccggcgaacaguuacuguuuuuccguucuaccaugccugguuguuccggguaucccaacauggaccucgauugccuucugccacaggaguggguacaauacuuuuaucaggaggccgcuccugcccagagcgacgucgcauugcuacgcuucgugaaucccgauacuggcagaguucuguuugaauguaagcuccacaaaucgggauacgugacggucgcccauacaggccagcacgaccuggugauuccaccgaacggguauuucagguuugauucuuggguaaaccaauucuacacccuugcuccuaugggaaaugguacuggccggcgacgcuga

SEQ ID NO: 20588 - RNA, 1617 nt, Artificial Sequence
  derived and/or modified sequence opt3 from VP1__Norovirus_and/or_Norovirus-like__AB933717
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagagauguuccuaaugugcaccuggcaccagccguagcucccaccuuuccuggugagcaguuacuguucuuuagguccacuaugcccggguguagcggcuauccaaacauggaccucgauugccuucugccucaggaguggguccagcauuucuaccaagaagcggcacccgcccagucggacguggcuuugcuacgguuuguuaauccagauacgggacgugugcuguucgaguguaaacuccacaagucuggcuaugucacaguggcccauaccgggcagcacgaccugguaauuccgccuaacggauacuuucgcuucgauuccugggugaaccaguucuauacucuugcacccauggguaauggcaccgggagaaggcgguga

SEQ ID NO: 20589 - RNA, 1617 nt, Artificial Sequence
  derived and/or modified sequence opt3 from VP1__Norovirus_and/or_Norovirus-like__AB933707
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccgggacuacaccaugaaccucgcuucucugaauuggaacaauuaugauccgacggaagagauucccgccccucuugguacuccagacuucguagggaagauccagggaaugcugacacagaccacuaagggcgacggcuccacacgcgggcacaaggcuaccguuuacacgggaucagcccccuuuaccccuaaauuggguagcgugcaguucaguacagauacugaaaacgacuuugagacccaucaaaauacaaaguucacuccagucggcgugauccaggaugggucuaccacacaccgaaacgaaccccagcaauggguccucccguccuacagcggaagaaaugugccuaacguucaccuggcaccagccguggcucccaccuuuccuggcgagcaguuacuguucuuuaggucgacuaugcccgguuguucuggguauccaaauauggaccucgauugccuucugccucaggaguggguacagcauuucuaccaagaagcggcacccgcccaguccgacgucgcuuugcuacgguuugugaacccagauacgggccguguucuguucgaguguaaacuccacaagucaggauaugugacagucgcccauaccggccagcacgaccuggugauuccgccuaauggguacuuucgcuucgauaguuggguaaaccaguucuauacucuugcacccaugggaaacgguaccggcagaaggcgguga

SEQ ID NO: 20590 - RNA, 1617 nt, Artificial Sequence
  derived and/or modified sequence opt3 from VP1__Norovirus_and/or_Norovirus-like__AB933705
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagacacuuuggagugcuccucugggaccagauuugaaucccuacuuaagccaccuggcccggauguauaacggcuacgcggguggguucgaagugcaggucauccuagcaggaaaugccuuuacugcuggcaaaauuaucuucgccgcagugccuccaaacuuuccgacggagggccucucccccucucagguaaccauguucccucauauuaucguugacgugcgccaacuggagccaguccuuauaccccugccugaugugcgaaauaacuuuuaucacuacaaucagucgaacgacucaacaaucaaguugauugcuaugcucuauacuccacugcgugccaacaaugcgggggaagauguguucaccgucagcugcagaguucugacaaggcccaguccggacuuugauuucaucuuucucgugccucccaccguagagucccggacuaaaccauucacagugccuauuuuaaccgucgaagagaugacgaacucucgcuuucccaucccacuggagaaacuuuucacuggacccagcuccgccuucgugguucagccucagaaugguagauguaccacagacggcguguugcuggggacuacccaacuaucaccagucaacauaugcacauuuaggggagaugugacccauauugcaggcagucggaauuacacgaugaaccucgcuagccugaauuggaacaauuaugacccgacugaagagauccccgccccucuugguacaccagauuucguagggaagauucagggaaugcugacccagacuacaaagggcgacggcucuacccgcgggcacaaggcuacgguuuacaccggauccgcccccuuuacaccuaaauuggguucagugcaguucagcacugacaccgaaaacgauuuugagacacaucaaaauacuaaguucaccccagucggcgugauccaggacgggaguacaacccaccgaaacgaaccccagcaauggguccucccgucuuacuccggaagaaaugugccuaacguucaccuggcaccagccguggcucccacuuuuccuggcgagcaguuacuguucuuuaggagcacgaugcccgguuguucgggguauccaaauauggaucucgacugccuucugccucaggaguggguacagcauuucuaccaagaagcggcacccgcccagucugaugucgcuuugcuacgguuugugaacccagacacaggccguguucuguucgaguguaaacuccacaaguccggauaugugaccgucgcccauacuggccagcacgaucuggugaucccgccuaacggguacuuucgcuucgacucauggguaaaucaguucuauacccuugcacccaugggaaacgguacaggcagaaggcgguga

SEQ ID NO: 20591 - RNA, 1617 nt, Artificial Sequence
  derived and/or modified sequence opt3 from VP1__Norovirus_and/or_Norovirus-like__AB933704
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagucuggcuaugucacaguggcccauaccgggcaguacgaucugguaauuccgccuaacggauauuuucgcuucgacuccugggugaaucaguucuacacucuugcacccauggguaacggcaccgggagaaggcgguga

SEQ ID NO: 20592 - RNA, 1617 nt, Artificial Sequence
  derived and/or modified sequence opt3 from VP1__Norovirus_and/or_Norovirus-like__AB933699
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucaguugaacgacucgacgaucaagcucauugcuaugcuguauaccccacugcgugccaacaaugcgggggaagauguguucacagucucaugcagaguucucacuaggcccagcccggacuuugauuucaucuuuuuagugccucccaccguagagagucggacaaaaccauucaccgugccuauacugacugucgaagagaugacaaacucccgcuuucccauuccacuugagaaguuguucaccggacccucuagcgccuucgugguucagccucagaaugguagauguacgacugacggcgugcugcuagggaccacacaacucuccccagucaacaucugcacuuuuaggggagaugugacccauauugcaggcucacggaauuacacaaugagucuggcuagccuuaacuggaauaacuaugacccgaccgaagagauccccgccccucuggguacgccagauuucguagggaaaauccagggaguuuugacucagacaaccaagggcgacggcucuacucgcgggcacaaggcuacaguguacaccggauccgcccccuuuacgccuaaacucgguucaguccaguucagcaccgacacagaaaaugauuuugagacucaucaaaacaccaaguucacaccagugggcgucauucaggacgggggaacuacccaccgaaaugaaccccagcaaugggugcugccgaguuacucuggcagaaacguuccuaaugugcacuuagcaccagccguagcucccacauuuccuggugagcagcuccucuucuuuagguccaccaugcccggguguagcggcuauccaaacauggaucuugacugccuguugccucaggaguggguccagcauuucuaccaagaagcggcacccgcccagucggauguggcucuacugcgguuuguuaauccagacacuggacgugugcuguucgaguguaaacugcacaagucuggcuaugucacgguggcccauacagggcagcacgaucuuguaauaccgccuaacggauacuuucgcuucgacuccugggugaaccaguucuauacccuggcacccauggguaauggcacugggagaaggcgguga

SEQ ID NO: 20593 - RNA, 1617 nt, Artificial Sequence
  derived and/or modified sequence opt3 from VP1__Norovirus_and/or_Norovirus-like__AB933679
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucauugugcagccucagaaugguagauguacuaccgacggcguuuugcuggggacaacucaacuaucaccagugaacaucugcaccuuuaggggagaugucacacauauugcaggcagucggaauuacaccaugaaccucgcuagccugaauuggaacaauuaugacccgacggaagagauccccgccccucuugguacuccagauuucguggggaagauccagggaguacugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauucaggacgggggaaccacacaccgaaacgaaccccagcaauggguccucccgaguuacucuggcagaaaugugccuaacguucaccuggcaccagccguggcucccaccuuuccuggugagcaguuacuguucuuuagguccacuaugcccggguguagcggcuauccaaauauggaucucgacugccuucugccucaggaguggguacagcauuucuaccaagaagcggcacccgcccagucggaugucgcuuugcuacgguuugugaacccagacacgggacguguucuguucgaguguaaacuccacaagucuggcuaugugacagucgcccauaccgggcagcacgaucuggugauaccgccuaacggauacuuucgcuucgacuccuggguaaaucaguucuauacucuugcacccauggguaacggcaccgggagaaggcgguga

SEQ ID NO: 20594 - RNA, 1617 nt, Artificial Sequence
  derived and/or modified sequence opt3 from VP1__Norovirus_and/or_Norovirus-like__AB933661
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugaaccucugggaccagauuugaaucccuacuuaagccaccuggcucggauguauaacggcuacgccgguggguucgaggugcaggucauucuagcgggaaaugcauuuacagccggcaaaaucauuuucgcugccgugccuccaaacuuuccgacugagggccucucccccucucagguaacgauguucccucauaucauaguugacgugcgccaacuggaaccaguccuuaucccccugccugaugugcgaaauaacuuuuaucacuacaaucagucgaacgacucaaccauuaaguugaucgcaaugcucuauacaccacugcgugcuaacaaugccggggaggauguguucacugucagcugcagaguucugaccaggcccaguccggacuuugauuucauuuuucucgugccucccacaguagaaucccggaccaaaccauucacugugccuaucuuaacagucgaggagaugaccaacucucgcuuucccauaccacuggaaaaacuuuucacgggacccagcuccgcguucgugguucagccucagaaugguagauguacuaccgacggcguguugcuggggacaacucaacuaucaccagucaacauuugcaccuuuaggggagaugugacacauaucgccggcagucggaauuacaccaugaaccucgcaagccugaauuggaacaauuaugacccgacggaggaaauucccgcuccucuugguacuccagauuucguagggaagauccagggaguucugacacagaccacuaagggcgacggcucuacacgcgggcacaaggccaccguguacacgggauccgcucccuuuaccccuaaauuggguucaguccaguucagcacagacacugagaacgauuuugaaacccaucaaaauacaaaguucacuccagugggcgucauccaggacgggggaaccacacaccgaaacgagccccagcaaugggugcucccgaguuacucuggcagaaauguuccuaacgugcaccuggccccagcaguagcccccaccuuuccuggugagcaguuacuguucuuuagguccacuaugcccggguguagcggcuauccaaauauggaucucgacugccuucugccucaggaauggguccagcauuucuaccaagaggcugcgcccgcacagucggauguggccuugcuacgguuuguuaacccagacacgggacgugugcuguucgaauguaaacuccacaagucuggcuaugucacaguggcucauaccgggcagcacgaucugguaauuccgccuaacggauacuuucgcuucgacuccugggugaaucaguucuauacucuugcccccauggguaacggcaccgggagaaggcgguga

SEQ ID NO: 20595 - RNA, 1617 nt, Artificial Sequence
  derived and/or modified sequence opt3 from VP1__Norovirus_and/or_Norovirus-like__KT152148
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuaugucacaguggcccacaccgggcagcacgaucugguaauuccaccgaacggauacuuucgcuucgacuccugggugaaucaguucuauacucuugcaccuauggguaacggcaccgggagaaggcgguga

SEQ ID NO: 20596 - RNA, 1617 nt, Artificial Sequence
  derived and/or modified sequence opt3 from VP1__Norovirus_and/or_Norovirus-like__EU921393
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucacaacuacaccaugaaucucgcuagccugaacuggaauaacuaugacccgacggaagagauucccgccccucuugggacuccagauuucguaggaaagauccagggcguucugacacagaccacuaagggcgacgggucuacacggggacauaaggcuaccguguacacggguuccgcccccuuuaccccuaaauugggcucaguccaguucagcacagacacugaaaaugauuuugagacccaccaaaacacaaaguucacuccagugggggucauccaggacggaaguaccacacaccgcaaugaaccccagcaaugggugcucccgucuuacuccggcagcaacguucauaaugugcaccuggccccugcaguagcuccaaccuuucccggugagcaguuacuguucuuucgaucgacuaugccuggguguucuggcuaucccaacauggaucucgacugccuucugccacaggaguggguccagcauuucuaccaagaagcggccccugcacaguccgauguggcuuugcuaagauuuguuaaucccgacacgggaagggugcuguucgaguguaaacuccacaagucaggcuaugucacaguggcccacaccgggcagcaugaucugguaauuccaccgaacggauacuuucgguucgacaguugggugaaccaguucuauacucuugcaccuauggguaauggcaccgggcgucgcagauga

SEQ ID NO: 20597 - RNA, 1617 nt, Artificial Sequence
  derived and/or modified sequence opt3 from VP1__Norovirus_and/or_Norovirus-like__KM396961
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauacaaccggcagccacaacuacacgaugaaucucgcaucucagaacugguccaauuaugaucccacugaggaaaucccugcuccacuggguacacccgacuucgucgggaagauacagggagugcuuacccagacuacacggaccgacggcucaacgcgcggccauaaggccaccguccgaacagggagcgcugauuuugccccuaagcugggaagagugcaauucgagacugacaccgaucacgacuuugaagcaaaccagaauacaaaauucacuccaguuggugugauucaggauggcaguaccacacacaggaacgagccccaacaguggguauugccgucuuacuccgggcggaauaccccuaacguccaucucgccccagcuguggcgcccacuuuuccuggagaacagcuguuauucuuucguagcacgaugcccggcuguucggguuacccaaauauggaccuggauugccuccuuccucaggaguggguucaacacuucuaucaggaggcagcccccgcucagucugacguggcccuguugcgcuuugucaacccagauacagggagagugcuauucgaauguaagcugcauaaauccggcuacguaaccguggcacacacuggacagcacgaccucguuaucccgccuaauggcuauuuuagguucgauucaugggucaaccaauucuacacccuggcccccauggggaacggaacaggucggcgacgcuga

SEQ ID NO: 20598 - RNA, 1617 nt, Artificial Sequence
  derived and/or modified sequence opt3 from VP1__Norovirus_and/or_Norovirus-like__KM198485
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagaccaacgacucgacaauuaaguugaucgcuaugcucuauacuccacugcgugccaacaaugcgggggaagauguguucaccgucucaugcagaguucugacaaggcccagcccggacuuugauuucauuuuucucgugccucccaccguagagagucggacuaaaccauucacagugccuaucuuaaccgucgaagagaugacgaacucccgcuuucccauaccacuggagaaacuuuucacuggacccucuagcgccuucgugguucagccucagaaugguagauguaccacagacggcguguugcuggggacuacccaacuauccccagucaacauuugcacauuuaggggagaugugacccauaucgcaggcucacggaauuacacgaugaaccucgcuagucugaauuggaacaauuaugacccgacugaagagauucccgccccucuugguacaccagauuucguagggaagauccagggaguucugacccagacuacaaagggcgacggcagcacccgcgggcacaaggcuacgguguacaccggaucugcccccuuuacaccuaaauuggguuccguccaguucucaacugacaccgaaaacgauuuugagacacaucaaaauacuaaguucaccccagugggcgucauccaggacgggggaacaacccaccgaaacgaaccccagcaaugggugcucccgagcuacaguggcagaaauguucacaacgugcaucuggccccugcaguagcuccaacuuuucccggugagcaguuacuguucuuuaggucuacgaugccuggguguuccggcuaucccaauauggaucucgacugccuucugccacaggaguggguccagcacuucuaccaagaagcggccccugcacagagcgauguggcuuugcuacgguuuguuaaccccgacacaggacgugugcuguucgaguguaaacuccauaagucgggcuaugucaccguggcccacacugggcagcacgaucugguaauuccaccgaacggauacuuucgcuucgacucuugggugaaucaguucuauacccuugcaccuauggguaacggcacagggagaaggcgguga

SEQ ID NO: 20599 - RNA, 1617 nt, Artificial Sequence
  derived and/or modified sequence opt3 from VP1__Norovirus_and/or_Norovirus-like__KF306214
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacugggugcccccgacuucgucgggaagauucagggagugcuuacucagacaacccgcacugacggcuccacacgaggccacaaggcuaccgucuacacggggucagccgauuuugcaccuaagcugggaagagugcaauucgagaccgacacagaucaugacuuugaaguuaaucagaacacuaaauucaccccaguggguguaauccaggauggcgggacaacucacaggaaugagccccaacagugggucuugccgagcuacaguggacggaacaccccuaaugugcaccucgccccagcuguugcgcccacauuuccuggcgaacagcuguuauucuuucguucuaccaugcccgguuguuccggguauccaaacauggaccuggauugccuccuuccucaggagugggugcaauacuucuaucaggaggcagcccccgcucagagcgacgucgcccuguugcgcuuugugaauccagauacuggcagaguacuauucgaauguaagcugcauaaaucgggauacgugacgguugcacacaacggccagcaugaccucgucauuccgccuaacggguauuuuagguucgauucuugggugaaucaauucuacacacuggcccccaugggaaacgguaccggccggcgacgcuga

SEQ ID NO: 20600 - RNA, 1617 nt, Artificial Sequence
  derived and/or modified sequence opt3 from VP1__Norovirus_and/or_Norovirus-like__JX439831
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuauugauggcguguugcuggggaccacacaacuaaguccggucaauaucugcacuuuuaggggagacgugacccauauuacaggcagccggaacuacaccaugaaucucgccacgcagaacuggaacucuuaugaucccacugaggaaaucccugcaccacuggguacacccgacuucguagggaagauccagggaguucuuacccagacuacacgcgcugacggcuccacccgaggccacaaggccacgguguacaccgggucagcugauuuugccccuaagcugggaagaguccaauucgcaacagacacugauaaugacuuugaugccaaucagaacaccaaauucacaccagugggugucauucaggacggcaauacugcucauaggaacgagccccaacaguggguguugccgagcuacagugggcguaauucucacaacguucaccucgcgccugcaguggccccaaccuuucccggagaacaguuccuguuuuuccgguccacaaugccuggcuguagcgguuaucccaauauggauuuagacugccugcucccacaggaguggguacaauacuuuuaucaggaagcugccccugcacagucggaugucgcccuucugcgcuucgugaaccccgacaccgggagaguuuuguuugaguguaagcuacauaaaucuggcuacgugacugucgcucacacgggacagcaugaucuggugauaccaccgaacggcuauuucagguucgacuccuggguaaaucaauuuuacacacucgccccuauggggaacggaaccggucggcgacgcuga

SEQ ID NO: 20601 - RNA, 1617 nt, Artificial Sequence
  derived and/or modified sequence opt3 from VP1__Norovirus_and/or_Norovirus-like__KC409281
augaagauggccagcaacgacgcuaaucccuccgauggcucugcagccucacuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagaccaacgacccaacaauuaaguugaucgcuaugcucuauacuccccugcgugccaauaacgcgggggaagauguguucaccgucagcugcagaguucugacaaggccgaguccugacuuugauuucauuuuucucgugcccccaaccguagagucccggacuaaaccuuucacagugcccaucuuaaccgucgaagagaugacgaacucucgcuuuccaauaccccuggagaaacuuuucacuggaccuagcggugccuucgugguucagccacagaauggcagauguaccacagacgggguguugcugggaacuacccaacuauccccggucaacauuugcacauuuaggggcgaugugacccauaucgcagguucacggaauuacacgaugaaccucgcuagucugaauuggaacaauuaugaccccacugaagagauuccugccccacuugggacacccgauuucguaggaaagauccagggcguucugacccagacuacaaagggcgacgggagcacccgcggacacaaggcuacgguguacaccgguucugccccuuuuacaccaaaauugggcuccguccaguucucaacugacaccgaaaacgauuuugagacacaucaaaauacuaaguucacccccgugggggucauccaggacggaggcacaacccaccgaaacgaaccgcagcaaugggugcucccuagcuacagugguagagauguucacaaugugcaucuggcaccagccguagcucccacuuuuccuggggagcaguuacuguucuuuaggucuacgaugcccggcuguuccggauauccaaacauggaccucgauugccuucugccucaggaguggguccagcacuucuaccaagaagcggcacccgcccagagcgacguggcuuugcuacgguuuguuaauccagauacaggccgugugcuguucgaguguaaacuccauaagucgggguaugucaccguggcccacacuggacagcacgaccugguaauuccgccuaacgguuacuuucgcuucgauucuugggugaaucaguucuauacccuugcacccaugggcaacgggacaggaagaaggcgguga

SEQ ID NO: 20602 - RNA, 1617 nt, Artificial Sequence
  derived and/or modified sequence opt3 from VP1__Norovirus_and/or_Norovirus-like__JX459639
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagaaaugugcagaacguucaccuggccccugcaguggcuccaaccuuucccggcgagcaguuacuguucuuuaggagcacuaugccugguuguucgggguaucccaauauggaucucgacugccuucugccacaggaguggguacaacauuucuaccaggaagcggccccugcacagucugaugucgcuuugcuacgguuugugaaccccgacacgggccguguucuguucgaguguaaacuccacaaguccggauaugugacagucgcccauaccggccagcacgaucuggugauuccaccgaacggguacuuucgcuucgacucauggguaaaucaauucuauacucuugcaccuaugggaaacgguaccggcagaaggcgguga

SEQ ID NO: 20603 - RNA, 1617 nt, Artificial Sequence
  derived and/or modified sequence opt3 from VP1__Norovirus_and/or_Norovirus-like__JX459609
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgcagugcagccucagaauggcagauguacuaccgacgggguuuugcugggaacaacucaacuauccccagugaacauuugcaccuuuaggggcgaugucacacauaucgcugguucacggaauuacaccaugaaccucgccagucugaauuggaacaauuaugacccgacggaagagauucccgcuccucuugggacuccagauuucgugggaaagauccagggcguacugacacagaccacuaagggcgacgggagcacacgcggacacaaggccaccguuuacacggguucugcacccuuuaccccuaaauugggcuccgugcaguucucaacagacacugaaaacgauuuugagacccaucaaaauacaaaguucacuccagucggggugauccaggacggaggcaccacacaccgaaacgaaccccagcaauggguccucccgagcuacagugguagaaaugugcacaacguucaucuggccccugcuguggcgccaaccuuucccggggagcaguuacuguucuuuaggucuacuaugccuggcuguuccggauaucccaauauggaucucgacugccuucugccacaggaguggguacagcacuucuaccaagaagcagccccugcucagagcgaugucgccuugcuacgguuugugaaccccgacacgggccguguucuguucgaguguaaacuccauaagucgggguaugcaacaguggcccacaccggacagcacgaucuggucauuccaccgaacgguuacuuucgcuucgacucuugggugaaucaguucuauacucuugcuccuaugggcaacgggaccggaagaaggcgguga

SEQ ID NO: 20604 - RNA, 1617 nt, Artificial Sequence
  derived and/or modified sequence opt3 from VP1__Norovirus_and/or_Norovirus-like__JN400599
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaaccagccgggacggcucuacgcgcggccacaaggccaccguguccacagggucaguccauuuuacuccuaagcugggaagcgugcaguucaguaccgauacaucuaaugacuuugagacuggucagaacacccgauucacaccagucggcgugguucaagauggguccaccacucaccagaaugaaccccagcaguggguguugccgaacuacagcggaagagacucgcacaauguacaucucgcuccugccgucgcaccaacguuucccggcgagcaacuguuauucuuuaggucuacaaugccugguuguuccggguaccccaacaugaaucuggauugccuccuuccacaggaaugggugcagcacuucuaucaggagucagccccugcucaaagugacguugcgcuguugcgguuugugaaccccgauaccggccguguccuauucgaguguaaacugcauaagccaggauacgugacuguagcacacaccggccagcacgaccucgugaucccgccuaacggguauuuucgcuucgauagcuggguuaaucaguucuacacacuggcccccaugggaaacggugcuggcagaaggcgguga

SEQ ID NO: 20605 - RNA, 1617 nt, Artificial Sequence
  derived and/or modified sequence opt3 from VP1__Norovirus_and/or_Norovirus-like__JQ613539
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucaacuuucgugguucagccacagaacgguagauguaccacagauggcguguugcuggggacuacccaacuaaguccggucaauauuugcacauuuaggggagacgugacccauaucgcgggcagccacaacuacacgaugaaucucgccucucagaacuggaacuccuaugaucccacugaggaaauuccugcaccacuggguacacccgacuucguagggaagauccagggaguucuuacccagacuacacggaccgacggcucaacgcgcggccauaaggcuaccguguacacagggagcgccgaguuuaguccuaagcugggacgaguccaauucgcuacugauaccaauaaugacuuugaugccaaccagaauacaaaauucacuccagugggugucauccaggacggcgggaccacacacagaaacgaaccccaacaguggguguugccgucuuacuccggaaggaauacccacaacguucaucucgcuccugccguggcuccaacuuuucccggcgagcagcuguuauucuuucggagcacgaugccugguuguucgggguaucccaauauggaucuggacugccucauuccacaggaauggguacaauacuucuaucaggaggcggccccugcacagucugaugucgcacuucugcguuuugugaaccccgacacaggccgcguuuuguucgaguguaagcuacacaaauccggauacgugaccgucgcccauacuggccagcacgaucuggugauaccaccgaacggguauuuuagauucgacucauggguaaaucaauucuacacccucgcaccuaugggaaacgguacaggcaggcggcgauga

SEQ ID NO: 20606 - RNA, 1617 nt, Artificial Sequence
  derived and/or modified sequence opt3 from VP1__Norovirus_and/or_Norovirus-like__HQ456329
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuaccucgugccucccacaguagagucccggaccaaaccauuuacugugccuaucuuaacagucgaagagaugaccaacucucgcuuccccauaccacuggagaaacuuuuuacgggacccagcggugccuucgugguucagccucagaauggcagauguacuaccgacgggguguugcugggaacaacucaacuauccccagucaacauuugcaccuucaggggcgaugugacacauaucgcagguucacggaauuauaccaugaaccucgcuagucugaauuggaacaauuacgacccgacggaagagauucccgccccucuugggacuccagauuuuguaggaaagauccagggcguucugacacagaccacuaagggcgacgggagcacacgcggacacaaggcuaccguguacacggguggcgcccccuucaccccuaaauuggggucuguccaguuuuccacagacacugaaaacgauuucgagacccaucaaaauacaaaguuuacuccagugggagucauccaggacggcucaaccacacaccgaaacgaaccccagcaaugggugcucccgagcuauagugguagaaauguucacaacgugcaucuggccccugcaguagcuccaaccuuccccggggagcaguuacuguuuuucaggucuacuaugccuggcuguuccggauaccccaauauggaucucgacugccuucugccacaggaguggguccagcacuuuuaucaagaagcggccccugcacagagcgauguggcuuugcuacgguucguuaaccccgacacgggccgugugcuguuugaguguaaacuccauaagucgggguacgucacaguggcccacaccggacagcacgaucugguaauuccaccgaacgguuauuuccgcuuugacucuugggugaaucaguucuacacucuugcaccuaugggcaacgggaccggaagaaggcgguga

SEQ ID NO: 20607 - RNA, 1617 nt, Artificial Sequence
  derived and/or modified sequence opt3 from VP1__Norovirus_and/or_Norovirus-like__HM802536
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuuggggcuccagauuucguaggaaagauccagggcguucugacucagacaaccaagggcgacgggagcacucgcggacacaaggccacaguguacaccgguucugcacccuuuacgccuaaauugggcuccguccaguucucaaccgacacagaaaacgauuuugagacucaucaaaauaccaaguucacaccagugggggucauccaggacggaagcacuacccaccgaaacgaaccccagcaaugggugcucccgaguuacucuggcagaaauguucacaacgugcaucuggccccugcuguagcgccaacauuucccggugagcaguuacuguucuuuagguccaccaugccuggguguagcggcuaucccaauauggaucucgacugccuucugccacaggaguggguccagcacuucuaccaagaagcagccccugcucagucggauguggccuugcuacgguuuguuaaccccgacacuggacgugugcuguucgaguguaaacuccauaagucuggcuaugucacgguggcacacacagggcagcacgaucugguaauuccaccgaacggauacuuucgcuucgacuccugggugaaucaguucuauacccuugccccuauggguaacggcacugggagaaggcgguga

SEQ ID NO: 20608 - RNA, 1617 nt, Artificial Sequence
  derived and/or modified sequence opt3 from VP1__Norovirus_and/or_Norovirus-like__HM802532
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugagucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugagacccaucaaaacacaaaguucacuccagugggggucauccaggacggaaguaccacacaccgaaaugaaccccagcaaugggugcucccgucuuacuccggcagaaacguucacaaugugcaucuggccccugcaguagcuccaaccuuucccggugagcaguuacuguucuuuaggagcacuaugccuggguguucgggcuaucccaacauggaucucgacugccuucugccacaggaguggguccagcacuucuaccaagaagcggccccugcacagucugauguggcuuugcuacgguuuguuaaucccgacacgggacgugugcuguucgaguguaaacuccauaaguccggcuaugucacaguggcccacaccgggcagcacgaucugguaauuccaccgaacggauacuuucgcuucgacucaugggugaaccaguucuauacucuugcaccuauggguaauggcaccgggagaaggcgguga

SEQ ID NO: 20609 - RNA, 1617 nt, Artificial Sequence
  derived and/or modified sequence opt3 from VP1__Norovirus_and/or_Norovirus-like__AB541341
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaacaccacacaccgaaaugaaccccagcaauggguccucccgaguuacucuggaagaaacgugcagaauguucaccuggccccugcaguggcuccaaccuuucccggcgagcaguuacuguucuuuagguccacuaugccugguuguagcggguaucccaacauggaucucgacugccuucugccacaggaguggguacaacauuucuaccaggaagcggccccugcacagucggaugucgcuuugcuacgguuugugaaccccgacacgggccguguucuguucgaguguaaacuccacaagucuggauaugugacagucgcccauaccggccagcacgaucuggugauuccaccgaauggguacuuucgcuucgacuccuggguaaaccaauucuauacucuugcaccuaugggaaaugguaccggcagaaggcgguga

SEQ ID NO: 20610 - RNA, 1617 nt, Artificial Sequence
  derived and/or modified sequence opt3 from VP1__Norovirus_and/or_Norovirus-like__AB541264
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccugucuuaacaguggaagagaugaccaacucucgcuuucccaucccacuggagaaacuuuucacgggacccagcuccgccuucguugugcagccucagaaugguagauguacuaccgacggcgucuugcuggggacaacucaacuaucaccagugaacauaugcaccuuuaggggagauguaacacauauugcaggcagucgggacuacaccaugaaucucgcuagccugaacuggaauaacuaugauccgacggaagagauccccgccccucuugguacuccagacuucguugggaagauucagggagugcugacacagaccacucgcggcgacggcucuacacgagggcacaaggcuaccgucuacacgggauccgcccccuuuaccccuaaguuggguucagugcaguucagcacagauacugaaaaugacuuugagacccaucaaaacacaaaauucacuccagucggcgugauccaggaugggggaaccacacacagaaaugaaccccagcaauggguucucccgaguuacucuggcaggaacgugccuaauguacaccuggcaccagccgucgcucccaccuuuccuggugagcaguuacuguucuuucgguccacuaugcccggguguagcggcuauccaaacauggaccucgauugccuucugccucaggagugggugcagcauuucuaccaagaagcggcacccgcccagucggacguugcuuugcuacguuuugugaauccagauacgggacgcguccuguucgaguguaagcuccacaaaucuggcuaugugacaguagcccauaccgggcagcacgaccuggugaucccgccuaacggauacuuuagauucgauuccuggguuaaccaguucuauacucuugcacccauggguaauggcaccgggaggcggcgauga

SEQ ID NO: 20611 - RNA, 1617 nt, Artificial Sequence
  derived and/or modified sequence opt3 from VP1__Norovirus_and/or_Norovirus-like__AB541236
augaagauggccagcaacgacgcuaaucccuccgauggcucugcagccaaccuggugcaggaggucaauaacgaaguuauggcgcucgagccugugguaggggcugccaucgcagccccaguggcuggacaacagaaugucauugacccguggauaagaaacaauuucgugcaggcacccgguggcgaauuuaccguuucaccuaggaacgccccaggggagauccuuuggagugcuccccugggaccugauuugaauccauacuuaagccaccuggcccggauguauaacggcuacgcggguggguucgaagugcaggucauucuagcaggaaaugccuuuacagcuggcaaaaucauuuucgccgcagugcccccuaacuuuccaacugagggccucuccccgucucaaguaacgauguucccccauaucauaguugacgugcgccagcuggagccuguccuuaucccacugcccgaugugcgaaauaacuuuuaucacuacaaucagucgaacgacucaaccauuaaguugaucgcuaugcucuauacaccucugcgugccaacaaugcgggggaagauguguucacugucagcugcagaguucugaccaggccaagucccgacuuugauuucauuuuucucgugccgccuacaguagagucccggaccaaacccuucacugugccaaucuuaacagucgaagagaugaccaacucucgcuuuccuauaccccuggagaaacuuuucacgggaccaagcuccgccuucgugguucagccccaaaaugguagauguacuaccgacggcguguugcuggggacaacucagcuaucaccugucaacauuugcaccuuuaggggagaugugacacauaucgcaggcagucggaauuacauuaugaaccucgcuagccugaauuggaacaauuaugacccaaccgaagagaucccggcuccccuugguacgccugauuucguagggaagauccagggaguucugacucagacaaccaagggcgacggcucuacucgcgggcacaaggccacaguguacaccggauccgccccauuuacgcccaaauuggguucaguccaauucagcaccgacacagaaaacgauuuugagacucaucagaauaccaaguucacaccugugggcgucauucaggacgggaguacuacccaccgaaacgaaccacaacagugggugcuccccucuuacuccggaggcaauguucacaacgugcaucuggcaccggccguagcuccuacauuuccaggugagcaguuacuguucuuuagaagcaccaugcccggguguucgggcuauccuaauauggaucucgacugccuucugccccaggaguggguccaacacuucuaccaggaagcggcaccagcccagucugauguggcuuugcuaagguuuguuaacccugacacuggacgggugcuguucgaguguaaacuccauaaguccggcuaugucacgguggcccacacagggcagcacgaucugguaauacccccaaacggauacuuucguuucgacucaugggugaaucaauucuauacccuugcaccgauggguaacggcacugggcgcagaagguga

SEQ ID NO: 20612 - RNA, 1617 nt, Artificial Sequence
  derived and/or modified sequence opt3 from VP1__Norovirus_and/or_Norovirus-like__AB541208
augaagauggccagcaacgaccccuccccuucugauggcucagcugcaaaucuggugccagaggucaacaaugaaguuauggcccucgagccggugguaggggcggcuaucgccgcacccguggccggacagcaaaacgucauugacccuuggauaagaaauaacuucgugcaggcuccagguggcgaauuuaccguuagucccaggaaugcaccuggggagauccuuuggagcgccccacugggacccgauuugaacccuuacuuaucccaccuggcucggauguauaauggcuacgccgguggguucgaagugcaggucauucuagcgggaaacgcauuuacagccggcaaaaucauuuucgcugccgugccaccgaauuuucccacugagggccucucuccuucgcagguaacgauguucccacauaucauaguugacgugcgccaacuggagcccguccuuaucccucugccagaugugcgaaacaauuuuuaucacuacaaccagucaaaugacagcaccauuaaguugaucgcaaugcucuauacaccccugcgugcuaacaacgccggggaagauguguucacugucaguugcagaguucugaccaggccguccccugacuuugauuucauuuuucucgugcccccaacaguagagucucggaccaaaccuuucacugugcccaucuuaacagucgaagagaugaccaauagccgcuuuccaauaccccuggagaaacuuuucacgggaccuuccucagcguucgugguucagccacagaacgguagauguacuaccgacggcguguugcuggggacaacucaacuaaguccggucaauauuugcaccuuuaggggagaugugacacauaucgccggcagccggaacuacaccaugaaucucgcaucucugaacuggaauaacuaugaccccacggaagagauuccugcuccacuugguacucccgauuucguagggaagauccagggaguucugacacagaccacuaagggcgacggcuccacacgcgggcacaaggccaccguguacacgggaucagcuccuuuuaccccaaaauuggguagcguccaguucaguacagacacugaaaaugauuuugagacccaucaaaacacaaaguucacucccgugggcgucauccaggacgggggaaccacacaccgaaaugaaccgcagcaaugggugcucccuucuuacuccggcagagauguucagaacgugcaccuggccccagcaguagcccccaccuuuccuggugagcaguuacuguucuuuaggagcacuaugcccggguguucgggcuauccaaauauggaccucgauugccuucugccucaggaguggguccaacauuucuaccaggaagcugcgcccgcacagucugacguggccuugcuacgguuuguuaacccagauacgggacgugugcuguucgaguguaaacuccacaaguccggcuaugucacaguggcucauaccgggcagcacgaccugguaauuccgccuaauggauacuuucgcuucgauucaugggugaaccaauucuauacucuugcccccauggguaacggcaccgggagaaggcgguga

SEQ ID NO: 20613 - RNA, 1617 nt, Artificial Sequence
  derived and/or modified sequence opt3 from VP1__Norovirus_and/or_Norovirus-like__EU876890
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccagauucacaccagucggcgugguucaagaugggucuaccacucaccagaaugaaccccagcaguggguguugccggacuacuccggaagggauagccacaacguacaucucgcuccugccgucgcaccaaauuuucccggcgagcaacuguuauucuuucggucgacgaugccugguuguucuggguaccccaacaugaaucuggacugccuccuuccacaggaaugggugcagcacuucuaucaggaguccgccccugcucaaucagauguugcgcuguugcguuuugugaaccccgacacaggccgcguccuauucgaguguaaacugcauaagaguggauacgugaccguagcacacacuggccagcacgaucucgugaucccaccgaacggguauuuuagauucgacagcuggguuaaucaguucuacacccuggccccuaugggaaacggugcuggcaggcggcgauga

SEQ ID NO: 20614 - RNA, 1617 nt, Artificial Sequence
  derived and/or modified sequence opt3 from VP1__Norovirus_and/or_Norovirus-like__AB385638
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccaacacccaggaguacacgaugaaucucgcaucucagaacuggaauaacuaugaucccacugaagagauuccugcuccacuggggacacccgacuucguaggcaagauccaggguguucuuacccaaacuacacggcgcgacggguccacccgaggacacaaggccacggugucaaccggcagcguccauuuuacaccuaagcugggcagaauccaguucaguacugauaccucuaaugacuuugaaacagggcagaacacuagguucaccccagugggagucgugcaagaugguuccacaacccaccagaaugagccccagcaguggguuuugccgaacuacagcggcggggacggacacaaugugcaucucgcuccugccguagcaccaucguuucccggcgaacaacuguuauucuuucggucuacuaugccugguuguuccggguaccccaacaugaaucuggauugccuccuuccacaggaguggguccagcacuucuaucaggaggccgcuccugcgcaaucagacguggcacuguugcguuuuguuaaccccgauacgggccgcgugcuauucgaauguaaacugcauaagaguggauacgucacaguggcccacaccggccagcacgaccucguaauuccaccgaacggguauuuuagauucgauagcugggugaaucaguucuacacucuggcuccuaugggaaacgguaccggcaggcggcgauga

SEQ ID NO: 20615 - RNA, 1617 nt, Artificial Sequence
  derived and/or modified sequence opt3 from VP1__Norovirus_and/or_Norovirus-like__AB385635
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagauucaugcagaguccugaccaggccgagcccugacuuugauuucauuuuucucguucccccaacuguggaaagucggacaaaaccuuucuccguacccaucuuaaccguggaggaaaugaccaauucucgcuuuccaauaccccuggagaaacuuuucacuggaccuagcuccgcguucgucgugcagccacagaacgguagauguaccacagacggcguuuugcuggggacuacccaacuaucaccggugaauauuugcacauuuaggggagaugucacccauaucgccggcacgcagaacuacacuaugaaucucgcaagucagaacuggaauaacuaugaccccacagaggaaauuccugcuccacuggguacccccgacuucguggggaagauccagggaguacuuacucaaacaacccggcgcgauggcagcacgcgaggccacaaggccaccguuucuacaggguccgugcauuuuacuccuaagcugggaucaguccaguucagcaccgacacaaguaaugauuuggagacuggucagaacaccagauuuacaccagugggcgucgugcaagacgggucuaccacucaccagaaugaaccccagcaguggguucucccggauuacuccggaagggacagccacaacgugcaucuggcuccugccguagcaccaacguuccccggcgagcaauuacuguuuuuccggucgacaaugccugguuguucuggguaccccaauaugaaccucgauugccuucugccacaggaauggguccagcacuuuuaucaggaguccgccccugcucaaucagacguggcguugcuacguuucguuaaucccgauaccggccgcgugcuguuugaguguaaacuccauaagaguggauacgucacuguggcacacaccggccagcacgaccugguaaucccaccgaacggguauuucagauuugauagcugggugaaccaguucuacacacuugccccuaugggaaauggugcuggcaggcggcgauga

SEQ ID NO: 20616 - RNA, 1617 nt, Artificial Sequence
  derived and/or modified sequence opt3 from VP1__Norovirus_and/or_Norovirus-like__EU366113
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccagagcaguacagacacugaaaacgauuucgagacccaucaaaauacaaaguuuacuccagugggcgucauccaggacgggucuaccacacaccgaaacgaaccccagcaaugggugcucccguccuacagcggaagaaauguucacaacgugcaucuggccccugcaguagcuccaaccuuccccggcgagcaguuacuguuuuucaggucgacugucccugguuguucuggguaucccaauauggaucucgacugccuucugccacaggagugggugcagcacuuuuaccaagaagcggccccugcacaguccgauguugcuuugcuacgguucgugaaccccgacacgggccguguccuguuugaguguaaacuccauaagucaggauaugugacaguagcccacaccggccagcacgaucuggugauuccaccgaacggguacuuccgcuuugacaguuggguuaaucaguucuauacucuugcaccuaugggaaacgguaccggcagaaggcgguga

SEQ ID NO: 20617 - RNA, 1617 nt, Artificial Sequence
  derived and/or modified sequence opt3 from VP1__Norovirus_and/or_Norovirus-like__KX354097
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacuaagacagacggcuccacccggggccauaaggccacggucuacaccgggucagcugauuuugccccuaaacugggacgcgugcaauucgagacagacacuaaucacgauuuugaagcaaaccagaauaccaaguucacaccaguuggugugauccaggacggcagcacuacccaccgaaacgagccccaacaguggguauugccgaguuacucugggagaaauacacauaacguccaccucgccccugcuguggcgccaaccuuucccggagaacagcuguuauucuuuagguccacuaugccuggcuguagcgguuaucccaauauggaucuggacugccuccuuccacaggaguggguucaauacuucuaucaggaggcagccccugcucagucggauguggcccuguugcgguuugucaaccccgacacggggcgugugcuauucgaauguaaacugcauaagucuggcuacguaacaguggcacacaccggacagcacgaucucguuauuccaccgaacggcuauuuucgcuucgacuccugggucaaucaauucuacacucuggccccuauggggaacggaaccgguagaaggcgguga

SEQ ID NO: 20618 - RNA, 1617 nt, Artificial Sequence
  derived and/or modified sequence opt3 from VP1__Norovirus_and/or_Norovirus-like__AB933727
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagguacccgccccucuugguacuccagauuucguugggaagauucagggagugcugacacagaccacuaagggcgacggcucuacacgcgggcacaaggcuaccgucuacacgggauccgcccccuuuaccccuaaauuggguucagugcaguucagcacagacacugaaaacgauuuugagacccaucaaaauacaaaguucacuccagucggcgugauccaggacgggggaaccacacaccgaaacgaaccccagcaauggguucucccgaguuacucuggcagagaugugccuaauguacaccuggcaccagccgucgcucccaccuuuccuggugagcaguuacuguucuuuagguccacuaugcccggguguagcggcuauccaaacauggaccucgauugccuucugccucaggagugggugcagcauuucuaccaagaagcggcacccgcccagucggacguugcuuugcuacgguuugugaauccagauacgggacguguccuguucgaguguaaacuccacaagucuggcuaugugacaguagcccauaccgggcagcacgaccuggugaucccgccuaacggauacuuucgcuucgauuccuggguuaaccaguucuauacucuugcacccauggguaauggcaccgggagaaggcgguga

SEQ ID NO: 20619 - RNA, 1617 nt, Artificial Sequence
  derived and/or modified sequence opt3 from VP1__Norovirus_and/or_Norovirus-like__AB933726
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagaaaugugccuaacguucaccuggcaccagccguggcucccaccuuuccuggcgagcaguuacuguucuuuaggagcacuaugcccgguuguucgggguauccaaauauggaucucgacugccuucugccucaggaguggguacagcauuucuaccaagaagcggcacccgcccagucugaugucgcuuugcuacgguuugugaacccagacacgggccguguucuguucgaguguaaacuccacaaguccggauaugugacagucgcccauaccggccagcacgaucuggugauuccgccuaacggguacuuucgcuucgacucauggguaaaucaguucuauacucuugcacccaugggaaacgguaccggcagaaggcgguga

SEQ ID NO: 20620 - RNA, 1617 nt, Artificial Sequence
  derived and/or modified sequence opt3 from VP1__Norovirus_and/or_Norovirus-like__AB933720
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagguucagggagugcugacacagaccacuaagggcgacggcuccacacgcgggcacaaggcuaccgucuacacgggaucagcccccuuuaccccuaaauuggguagcgugcaguucaguacagacacugaaaaugauuuugagacccaucaaaacacaaaguucacuccagucggcgugauccaggacgggucuaccacacaccgaaaugaaccccagcaauggguucucccguccuacagcggaagaaacgugccuaauguacaccuggcaccagccgucgcucccaccuuuccuggcgagcaguuacuguucuuuaggucgacuaugcccgguuguucuggguauccaaacauggaucucgacugccuucugccucaggagugggugcagcauuucuaccaagaagcggcacccgcccaguccgauguugcuuugcuacgguuugugaauccagacacgggccguguccuguucgaguguaaacuccacaagucaggauaugugacaguagcccauaccggccagcacgaucuggugaucccgccuaacggguacuuucgcuucgacaguuggguuaaccaguucuauacucuugcacccaugggaaaugguaccggcagaaggcgguga

SEQ ID NO: 20621 - RNA, 1617 nt, Artificial Sequence
  derived and/or modified sequence opt3 from VP1__Norovirus_and/or_Norovirus-like__AB933691
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagagaugugccuaauguucaccuggcaccagccguggcucccaccuuuccuggcgagcaguuacuguucuuuaggagcacuaugcccgguuguucgggguauccaaacauggaccucgauugccuucugccucaggaguggguacagcauuucuaccaagaagcggcacccgcccagucugacgucgcuuugcuacgguuugugaauccagauacgggccguguucuguucgaguguaaacuccacaaguccggauaugugacagucgcccauaccggccagcacgaccuggugauuccgccuaacggguacuuucgcuucgauucauggguaaaccaguucuauacucuugcacccaugggaaaugguaccggcagaaggcgguga

SEQ ID NO: 20622 - RNA, 1617 nt, Artificial Sequence
  derived and/or modified sequence opt3 from VP1__Norovirus_and/or_Norovirus-like__AB933682
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcuccgcguucgugguucagccucagaaugguagauguaccacagacggcguguugcuggggacuacccaacuaucaccagucaacauuugcacauuuaggggagaugugacccauaucgccggcagucacaauuacacgaugaaccucgcaagccugaauuggaacaauuaugacccgacugaagagauucccgcuccucuugguacaccagauuucguagggaagauccagggaguucugacccagacuacaaagggcgacggcucuacccgggggcauaaggccacgguguacaccggauccgcucccuuuacaccuaaauuggguucaguccaguucagcacugacaccgaaaacgauuuugagacacaccaaaauacuaaguucaccccagugggcgucauccaggacgggggaacaacccaccgcaacgaaccccagcaaugggugcucccgaguuacucuggccgaaauguucagaacgugcaucuggccccugcaguagccccaacuuuucccggugagcaguuacuguucuuuagauccacgaugccuggguguagcggcuaucccaauauggaucucgacugccuucugccacaggaguggguccaacacuucuaccaggaagcugcgccugcacagucggauguggccuugcuaagguuuguuaaccccgacacaggacgggugcuguucgaguguaaacuccauaagucuggcuaugucaccguggcucacacugggcagcacgaucugguaauuccaccgaacggauacuuucguuucgacuccugggugaaucaauucuauacccuugccccuauggguaacggcacagggcgcagaagguga

SEQ ID NO: 20623 - RNA, 1617 nt, Artificial Sequence
  derived and/or modified sequence opt3 from VP1__Norovirus_and/or_Norovirus-like__KM245069
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccucuacccaggaguacacgaugaaccucgcaucccagaauuggaacaauuaugaucccacugaagagauuccugcuccacuggggacacccgacuucguaggcaagauccaggguguucuuacccaaacuacacggcgcgacgggucaacccgaggacacaaggccacggugagcaccggcaguguccauuuuacaccuaagcugggcagaauccaguucucuacugauaccuccaacgacuuugaaacagggcagaauacuagguucaccccagugggagucgugcaagaugguagcacaacccaccagaacgagccccagcaguggguuuugccgaauuacucgggccgggacucucacaacgugcaucucgcuccugccguagcaccauccuuucccggggaacaacuguuauucuuucguucaacuaugccuggauguaguggcuaccccaauaugaaccuggauugccuccuuccacaggaguggguccagcacuucuaucaggaggccgcuccugcgcaaagcgacguggcacuguugcgcuuuguuaaucccgauacggguagagugcuauucgaauguaaacugcauaaguccggguacgucacaguggcccacaccggccagcacgaccucguaauuccaccgaacggauauuuuagguucgauucuugggugaaccaguucuacacucuggcuccuaugggcaaugggaccggacggcgacgcuga

SEQ ID NO: 20624 - RNA, 1617 nt, Artificial Sequence
  derived and/or modified sequence opt3 from VP1__Norovirus_and/or_Norovirus-like__LC005717
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggaucaaaaacaauuucgugcaggcaccugguggcgaauuuaccguuucaccaagaaacgcccccggggagauacuuuggagugcuccucugggaccagauuugaaucccuacuuaagccaccuggccaggauguauaacggcuacgcggguggguucgaagugcaggucauucuagcaggaaaugccuuuacagcuggcaagaucauuuucgccgcagugccuccaaacuuuccgacugagggccucucccccucucagguaacgauguucccucauaucauaguugacgugcggcaacuggagccaguccuuaucccccugccugaugugcgcaauaacuuuuaucacuacaaucagucgaacgacucaaccauuaaauugaucgcuaugcucuauacaccacugcgagccaacaaugcgggggaagauguguucacugucagcugccguguucugaccagacccaguccggacuuugauuucauuuuucucgugccucccacaguagaguccaggaccaagccauucacugugccuaucuuaacagucgaagagaugaccaacucucgguuucccauaccacuggagaaacuuuucacgggacccagcggugccuucgugguucagccucagaauggccgcuguacuaccgacgggguguugcugggaacaacucaacuauccccagucaacauuugcaccuuuagaggcgaugugacacauaucgcagguucaaggaauuacaccaugaaccucgcugcccugaauuggaacaauuaugacccgacggaagagauucccgcuccucuugggacuccagauuucguaggaaagauccagggcguucugacacagaccacuaagggcgacgggaguacacggggacacaaagccaccguguacacggguagcgcagacuuuacccccaaguugggcucuguccaguucuccacagauacugaaaacgacuuugagacccaucaaaauacaaaauucacuccugugggggucauccaggauggaucaaccacacaccgcaacgaaccacagcaaugggugcuccccagcuacaguggccgaaauguucacaacgugcaucuggccccggcuguagcgccuaccuuuccaggugagcaguuacuguucuuuagaucuacuaugcccggguguuccggcuauccuaauauggaccucgauugccuucugccccaggaguggguccagcacuucuaccaagaagcagccccagcucagagcgacguggccuugcuaagguuuguuaacccugauacgggacgggugcuguucgaguguaagcuccauaaaucgggcuaugucacaguggcacacaccgggcagcacgaccugguaauucccccaaacggauacuuucguuucgauucuugggugaaucaguucuauacucuugccccgauggguaacggcaccgggcgcagaagguga

SEQ ID NO: 20625 - RNA, 1617 nt, Artificial Sequence
  derived and/or modified sequence opt3 from VP1__Norovirus_and/or_Norovirus-like__LC005705
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccaucuacacggguucugcccccuuuaccccuaaauugggcuccgugcaguucucaacagacacugaaaacgauuuugagacccaucaaaauacaaaguucacuccagucggggugauucaggacggaagcaccacacaccgaaacgaaccccagcaauggguccucccgaguuacucuggcagaaaugugcacaacguucaucuggccccugcaguggcuccaaccuuucccggugagcaguuacuguucuuuagguccacuaugccuggguguagcggcuaucccaauauggaucucgacugccuucugccacaggaguggguacagcacuucuaccaagaagcggccccugcacagucggaugucgcuuugcuacgguuugugaaccccgacacgggacguguucuguucgaguguaaacuccauaagucuggcuaugugacagucgcccacaccgggcagcacgaucuggugauaccaccgaacggauacuuucgcuucgacuccuggguaaaucaguucuauacucuugcaccuauggguaacggcaccgggagaaggcgguga

SEQ ID NO: 20626 - RNA, 1617 nt, Artificial Sequence
  derived and/or modified sequence opt3 from VP1__Norovirus_and/or_Norovirus-like__KC894943
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaauuacaguggcucugauguuccuaacgugcaccuggcaccagccguagcucccaauuuuccuggugagcaguuacuguucuuuagauccaccaugcccggguguagcggcuauccaaacauggaccucgauugccuucugccucaggaguggguccagcauuucuaccaagaagcggcacccgcccagucggacguggcuuugcuaagguuuguuaacccagauacuggacgggugcuguucgaguguaaacuccacaagucuggcuaugucacgguggcccauacagggcagcacgaccugguaauuccgccuaauggauacuuucguuucgauuccugggugaaccaguucuauacccuugcacccauggguaauggcacugggcgcagaagguga

SEQ ID NO: 20627 - RNA, 1617 nt, Artificial Sequence
  derived and/or modified sequence opt3 from VP1__Norovirus_and/or_Norovirus-like__KF060023
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgguacagacacugaucaugacuuugaggcaaaccagaauaccaaauucacaccaguuggcgugauccaggaugggaguacuacccacaggaacgaaccccaacaguggguauugccgucuuacuccggacggaauacaccuaacguccaccucgccccagcuguggcgcccaccuuuccuggcgagcagcuguuauucuuucguagcacuaugcccgguuguucgggguauccaaauauggaccuggauugccuccuuccucaggaauggguucaauacuucuaucaggaggcagcccccgcucagucugacguggcccuguugcgcuuugucaacccagauacgggcagagugcuauucgaguguaagcugcauaaauccggauacguaacaguggcacacaccggccagcaugaccucguuauuccgccuaauggguauuuuagguucgauucaugggucaaccaauucuacacucuggcccccaugggaaacgguaccggccggcgacgcuga

SEQ ID NO: 20628 - RNA, 1617 nt, Artificial Sequence
  derived and/or modified sequence opt3 from VP1__Norovirus_and/or_Norovirus-like__KC409310
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacccaacaauuaaguugaucgcuaugcucuauacuccccugcgugccaacaacgcgggggaagauguguucaccgucucaugcagaguucugacaaggccgagcccugacuuugauuucauuuuucucgugcccccaaccguagagagucggacuaaaccuuucacagugcccaucuuaaccgucgaagagaugacuaauucccgcuuuccaauaccccuggagaaacuuuucacgggaccuucuggugccuucgugguucagccacagaacggcagauguaccacagacgggguguugcugggaacuacccaacuaagcccggucaauauuugcacauuuaggggcgaugugacccauaucgcagguucccggaacuacacgaugaaucucgcuucacugaacuggaauaacuaugaccccacugaagagauuccugccccacuugggacacccgauuucguaggaaagauccagggcguucugacccagacuacaaagggcgacgggaguacccgcggacacaaggcuacgguguacaccgguagcgccccuuuuacaccaaaauugggcucuguccaguucuccacugacaccgaaaaugauuuugagacacaucaaaacacuaaguucacccccgugggggucauccaggacggaggcacaacccaccgaaaugaaccgcagcaaugggugcucccuucauacagcgguagagauguucacaacgugcaucuggcaccagccguagcucccacuuuuccuggggagcaguuacuguucuuuaggaguacgaugcccggcuguucuggauauccaaauauggaccucgauugccuucugccucaggaguggguccagcacuucuaccaagaagcggcacccgcccaguccgacguggcuuugcuacgguuuguuaacccagauacaggccgugugcuguucgaguguaaacuccauaagagcggguaugucaccguggcccacacuggacagcacgaccugguaauuccgccuaaugguuacuuucgcuucgauucgugggugaaccaguucuauacccuugcacccaugggcaacgggacaggaagaaggcgguga

SEQ ID NO: 20629 - RNA, 1617 nt, Artificial Sequence
  derived and/or modified sequence opt3 from VP1__Norovirus_and/or_Norovirus-like__JX989073
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagagauauuccuaaugugcaccuggcaccagccguugcucccaccuuuccuggcgagcaguuacuguucuuuaggagcacuaugcccgguuguucgggguauccaaacauggaccucgauugccuucugccucaggagugggugcagcauuucuaccaagaagcggcacccgcccagucugacguagcuuugcuacgguuugucaauccagauacgggccgugugcuguucgaguguaaacuccacaaguccggauauguuacaguggcccauaccggccagcacgaccuggucauaccgccuaacggguacuuucgcuucgauucaugggugaaccaguucuauacucuugcacccaugggaaaugguaccggcagaaggcgguga

SEQ ID NO: 20630 - RNA, 1617 nt, Artificial Sequence
  derived and/or modified sequence opt3 from VP1__Norovirus_and/or_Norovirus-like__JX459902
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaucguuuccgaucgagggccucucacccagccagguaacgauguucccucauauaaucguugacgugcgccaacuggagccaguccuuauuccccugccugaugugcgaaacaauuuuuaucacuacaaccagaguaaugacccaaccaucaaguugauugcaaugcucuauacaccccugcgugcuaacaaugccggggaugacguguucacugucuccugcagaguucugaccaggccgucuccugauuuugacuucaucuuucucgugcccccaacaguagaaagccggaccaaaccuuucuccgugcccgucuuaacuguggaggaaaugacaaacucacgcuuuccaauaccccuggagaaacuuuucaccggaccuaguagcgcguucguugugcagccacagaacgguagauguacgacugauggcgucuugcuggggaccacacaacuaucuccggugaauauuugcacuuuuaggggaaacguaacccauaucuccggcucacggaauuacacaaugaaccucgccagccagaauuggaacaguuaugaccccaccgaggaaauuccugcaccacuggguacgcccgauuucguugggaagauccagggagugcuuacucagacaaccaagacuaauggcucuacacgcggccacaaggcuaccgucuacacgggguccgccgacuuuagcccuaaacugggacgagugcaauucgcuaccgacacagauaacgacuuugagacuaaucagaacaccaaguucacaccagucggugugauccaggauggcucgacuacccccagaaaugaaccgcaacaguggguuuugccuucuuacuccgggaggaacacacauaaugugcaccucgccccagcaguagcccccaccuuuccuggagagcagcuguuauucuuucggucaacuaugcccggcuguagugguuauccaaacauggaccuggauugccuccuuccucaggaauggguccaauacuucuaucaggaggcugcgcccgcacagagcgacguggcccuguugcguuuuguuaauccagauacggggcgcgugcuauucgaguguaaacugcacaaguccggcuacgucacaguggcucauaccggacagcacgaccucguaauuccgccuaacggcuauuuuagauucgauucuugggugaaccaauucuacacucuggcccccauggggaauggaaccgguaggcggcgauga

SEQ ID NO: 20631 - RNA, 1617 nt, Artificial Sequence
  derived and/or modified sequence opt3 from VP1__Norovirus_and/or_Norovirus-like__JX459644
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcugcccugaauuggaacaauuaugacccgacggaagagauucccgcuccucuugggacuccagauuucguaggaaagauccagggcguucugacacagaccacuaagggcgacgggaguacacgcggacacaaggccaccguguacacggguagcgcagacuuuacccccaaauugggcucuguccaguucuccacagauacugaaaacgacuuugagacccaucaaaauacaaaguucacuccugugggggucauccaggauggaucaaccacacaccgaaacgaaccacagcaaugggugcuccccagcuacaguggcagaaauguucacaacgugcaucuggccccggcuguagcgccuaccuuuccaggugagcaguuacuguucuuuaggucuacuaugcccggguguuccggcuauccuaauaugaaccucgacugccuuauuccccaggaguggguccagcacuucuaccaagaagcagccccagcucagagcgauguggcccuguugcgguuuguuaacccugacacgggacgugugcuauucgaguguaaacugcauaagucgggcuaugucacaguggcacacaccgggcagcacgaucucguaauacccccaaauggauacuuucgcuucgacucuugggugaaccaguucuauacucuggccccgauggguaauggcgcugggagaaggcgguga

SEQ ID NO: 20632 - RNA, 1617 nt, Artificial Sequence
  derived and/or modified sequence opt3 from VP1__Norovirus_and/or_Norovirus-like__JX459610
augaagauggccagcaacgacgcucaccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuucaccaaggaaugcccccggggagauccuuuggagugcuccucugggaccagauuugaaccccuacuuaagccaucuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucacaucauaguugacgugcgccaacuggagccaguccuuaucccccugccugaugugcgaaacaauuuuuaucauuacaaccagucgaaugacucaaccauuaaguugaucgcuaugcucuauacaccacugcgugccaacaacgcgggggaagauguguucacugucagcugcagaguucugaccaggcccaguccggacuuugauuucauuuuucucgugccucccacaguagagucccggaccaaaccauucacugugccuaucuuaacagucgaagagaugaccaauucucgcuuucccauaccacuggagaaacuuuucacgggacccagcggugccuucgugguucagccucagaacggcagauguacuaccgacgggguguugcugggaacaacucaacuauccccagucaauauuugcaccuuuaggggcgaugugacacacaucgcagguucacggaacuacaccaugaaucucgcuagucugaacuggacgaauuaugacccgacugaagagauucccgccccucuugggacaccagauuucguaggaaagauccagggcguucugacccagacuacaaagggcgacgggagcacccgcggacauaaggcuacgguguacaccgguucugcccccuuuacaccuaaauugggcuccguccaguucucaacugacaccgaaaacgauuuugagacacaccaaaauacuaaguucaccccagugggggucauccaggacggaggcacaacccaccgaaacgaaccccagcaaugggugcucccgagcuacagugguagaaauguucauaacgugcaccuggccccugcaguagcuccaacuuuucccggggagcaguuacuguucuuuaggucuacgaugccuggcuguuccggauaucccaauauggaucucgacugccuucugccacaggaguggguccagcauuucuaccaagaagcggccccugcacagagcgauguggcuuugcuacgguuuguuaaccccgacacaggccgugugcuguucgaguguaaacuccacaagucgggguaugucaccguggcccacacuggacagcaugaucugguaauuccaccgaaugguuacuuucgcuucgacucuugggugaaccaguucuauacccuugcaccuaugggcaacgggacaggaagaaggcgguga

SEQ ID NO: 20633 - RNA, 1617 nt, Artificial Sequence
  derived and/or modified sequence opt3 from VP1__Norovirus_and/or_Norovirus-like__JX459606
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggcgggcuccucugggaccagauuugaaucccuacuuaagucaccuggcccgcauguauaacggcuacgcggguggguucgaagugcaggucauucuagcaggaaaugccuuuacagcuggcaaaaucauuuucgccgcagugccuccaaacuuuccgacugagggccucagccccucccagguaacgauguucccucauaucauaguugacgugcgacaacuggagccaguccuuaucccccugccugaugugcguaauaacuuuuaucacuacaaucagucuaacgacucgaccauuaaguugaucgcuaugcucuauacaccacugagagccaacaaugcgggggaagauguguucacugucucaugcaggguucugacccggcccagcccggacuuugauuucauuuuucucgugccucccacaguagagagucgcaccaaaccauucacugugccuaucuuaacagucgaagagaugaccaacuccagauuucccauaccacuggagaaacuuuucacgggacccucuagcgccuucgugguucagccucagaaugguagguguacuaccgacggcguguugcuggggacaacucaacuauccccagucaacauuugcaccuuucggggagaugugacacauaucgcaggcucacgcaauuacaccaugaaccucgcuagucugaauuggaacaauuaugacccgacggaagagguacccgccccucuugguacuccagauuucguugggaagauucagggagugcugacacagaccacuaagggcgacggcagcacacgagggcacaaggcuaccgucuacacgggaucugcccccuuuaccccuaaauuggguuccgugcaguucucaacagacacugaaaacgauuuugagacccaucaaaauacaaaguucacuccagucggcgugauccaggacgggagcaccacacacagaaacgaaccccagcaauggguucucccgaguuacucuggaaggaaugugcacaacguacaucuggccccugcagucgcuccaaccuuucccggcgagcaguuacuguucuuucgguccacuaugccugguuguagcggguaucccaauauggaucucgacugccuucugccacaggagugggugcagcacuucuaccaagaagcggccccugcacagucggauguugcuuugcuacguuuugugaaccccgacacgggccgcguccuguucgaguguaaacuccauaagucuggauaugugacaguagcccacaccggccagcacgaucuggugaucccaccgaacggguacuuuagauucgacuccuggguuaaucaguucuauacucuugcaccuaugggaaacgguaccggcaggcggcgauga

SEQ ID NO: 20634 - RNA, 1617 nt, Artificial Sequence
  derived and/or modified sequence opt3 from VP1__Norovirus_and/or_Norovirus-like__JX445159
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacugaaggcgacggcucuacacgcgggcacaaggcuaccguguacacgggauccgcccccuuuaccccuaaguuggguucaguccaguucagcacagacacugagaacgauuuugaaacccaucaaaauacaaaauucacuccagugggcgucauccaggacgggaguaccacacaccgaaacgagccccagcaaugggugcucccgucuuacuccggaagaaauguucacaacgugcaucuggccccugcaguagcuccaaccuuucccggcgagcaguuacuguucuuuaggagcacuaugccugguuguucgggguaucccaauauggaucucgacugccuucugccacaggaauggguccagcacuucuaccaagaggcggccccugcacagucugauguggcuuugcuacgguuuguuaaccccgacacgggccgugugcuguucgaauguaagcuccauaaauccggauaugucacaguggcccacaccggccagcacgaucugguaauuccaccgaacggguacuuucgcuucgacucaugggugaaucaguucuauacucuugcaccuaugggaaacgguaccggcagaaggcgguga

SEQ ID NO: 20635 - RNA, 1617 nt, Artificial Sequence
  derived and/or modified sequence opt3 from VP1__Norovirus_and/or_Norovirus-like__JN400606
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggaggugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuaugucacaguggcccacaccgggcagcacgaucugguaauuccaccgaacggauacuuucgcuucgacuccugggugaaucaguucuauacucuugcaccuauggguaacggcaccgggagaaggcgguga

SEQ ID NO: 20636 - RNA, 1617 nt, Artificial Sequence
  derived and/or modified sequence opt3 from VP1__Norovirus_and/or_Norovirus-like__JQ613562
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaucuuucacugugccaaucuuaacagucgaggaaaugaccaacagccgcuuuccuauaccccuggagaaacuuuucacgggaccauccucagccuucgugguucagccccagaaugguagauguacuaccgauggcguguugcuggggacaacucaacuaaguccugucaacauuugcaccuuuaggggagacgugacacauaucgcaggcagccggaauuacaccaugaaccucgcuucucugaauuggaacaauuaugauccaacggaggaaauuccggcuccccuugguacuccugacuucguagggaagauccagggaguucugacacagaccacuaagggcgacggcuccacacgcgggcacaaggccaccguguacacgggaucagccgauuuuaccccaaaauuggguagcguccaguucggcacagacacugauaacgacuuugagacccaucaaaauacaaaguucacucccgugggggucauccaggauggaaguaccacacaccgaaacgaaccucagcaaugggugcucccaucuuacuccggcagaaauguucacaacgugcaucuggcacccgccguagcuccgaauuuuccuggugagcaguuacuguucuuuaggagcaccaugccaggguguucgggcuaucccaacauggaccucgauugccuucugccucaggaauggguccagcacuucuaccaagaggcggcacccgcccagucugacguggcuuugcuacgguuuguuaacccagauacuggacgugugcuguucgaguguaaacuccauaaguccggcuaugucacgguggcccacacagggcagcacgaccugguaauuccucccaauggauacuuucgcuucgauucaugggugaaccaguucuauacccuugcaccaauggguaauggcgccgggagaaaaagguga

SEQ ID NO: 20637 - RNA, 1617 nt, Artificial Sequence
  derived and/or modified sequence opt3 from VP1__Norovirus_and/or_Norovirus-like__HQ456343
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucgcaacagacacugagaacgauuuugaaacccaucaaaauacaaaguucacuccugugggcgucauccaggacgggagcaccacacaccgaaacgagccacagcaaugggugcccccgaguuacucuggaagaaauguucacaacgugcaucucgccccugcuguagcgccaaauuuucccggcgaacagcuguuauucuuuagguccaccaugccugguuguagcggguaucccaacauggaucuggacugccuccuuccacaggaguggguccagcacuucuaccaagaggcagccccugcucagucggauguggcccuguugcgguuuguuaaccccgacacuggccgugugcuauucgaauguaaacugcauaagucuggauaugucacgguggcacacacaggccagcacgaucucguaauuccaccgaauggguacuuucgcuucgacuccugggugaaccaguucuauacccuggccccuaugggaaaugguacuggcagaaggcgguga

SEQ ID NO: 20638 - RNA, 1617 nt, Artificial Sequence
  derived and/or modified sequence opt3 from VP1__Norovirus_and/or_Norovirus-like__HQ456342
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcgggaccgcucauaggaaugagccccaacaguggguguugccgagcuacaguggacggaacucucacaauguucaccucgcgccugcaguggccccaacauuucccggcgaacagcuguuauucuuucguuccaccaugccugguuguagcggguaucccaacauggaucuggacugccuccuuccacaggaguggguacaauacuucuaucaggaagcugccccugcacagucggaugucgcccuguugcgcuuugugaaucccgacacuggcagaguucuauucgaguguaagcugcauaaaucuggauacgugacggucgcucacacaggccagcaugaucucgugauuccaccgaacggguauuuuagguucgacuccuggguaaaccaauucuacacccuggccccuaugggaaaugguacuggccggcgacgcuga

SEQ ID NO: 20639 - RNA, 1617 nt, Artificial Sequence
  derived and/or modified sequence opt3 from VP1__Norovirus_and/or_Norovirus-like__HQ456340
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucuucgucacagguaacgauguucccccauaucauaguugacgugcgccaacuggagccuguccuuaucccacugcccgaugugcgaaacaauuuuuaucacuacaaccagagcagugacuccaccauuaaguugaucgcuaugcucuauacaccucugcgugccaauaacgcgggggaagauguguucacugucucuugcagaguucugaccaggccaagccccgacuuugauuucauuuuucucgugccgccuacaguagagucccggaccaaacccuucacugugccaaucuuaacagucgaagagaugaccaacucacgcuuuccuauaccccuggagaaacuuuucacgggaccaaguggugccuucgugguucagccccagaauggcagauguacuaccgacgggguguugcugggaacaacucaacuaagcccugucaacauuugcaccuuuaggggcgaugugacacauaucgcagguucucggaauuacaccaugaaccucgcugcccugaauuggaacaauuaugacccaacggaagagauuccggcuccccuugggacuccugauuucguaggaaagauccagggcguucugacacagaccacuaaggccgacggcuccacacgcgggcacaaggcaaccguguacacgggaucagccgacuuuaccccaaaauuggguagcguccaguucaguacagauacugaaaacgacuuugagacccaucaaaauacaaaguucacucccgugggcgucauccaggaugggucuaccacacaccgaaacgaaccucagcaaugggugcucccauccuacagcggaagaaauguucacaacgugcaucuggcucccgcgguagcaccgaccuuuccuggcgagcaguuacuguucuuuaggucgacuaugccagguuguucuggguaucccaauauggaccucgauugccuucugccucaggaguggguccagcacuucuaccaagaagccgcucccgcccaguccgacguggcauugcuacgguuuguuaacccagauacgggccgugugcuguucgaguguaaacuccauaagucaggauaugucacaguggcccacaccggccagcacgaccugguaauuccucccaauggguacuuucgcuucgauaguugggugaaccaguucuauacucuugcuccaaugggaaacgguaccggcagaaggcgguga

SEQ ID NO: 20640 - RNA, 1617 nt, Artificial Sequence
  derived and/or modified sequence opt3 from VP1__Norovirus_and/or_Norovirus-like__HQ456326
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucguuguggacguccgccaacuggagccagugcuuauaccccugccugaugugcgaaauaacuuuuaucacuacaaucagucgaacgacucaaccaucaaguugauugcuaugcucuauacaccacugcgugccaacaaugcgggggaagaugucuucacuguuagcugcagagugcugaccaggcccaguccggacuuugauuucaucuuucucguaccucccacaguggagucccggaccaaaccauucacugucccuauuuuaacaguggaagagaugaccaacucucgcuuucccaucccacuggagaaacuuuucacgggacccagcggugccuucguugugcagccucagaauggcagauguacuaccgacggggucuugcugggaacaacucaacuauccccagugaacauaugcaccuuuaggggcgauguaacacauauugcagguucacggaauuacaccaugaaccucgcuagucugaauuggaacaauuaugacccgacggaagagauccccgccccucuugggacuccagauuucguuggaaagauucagggcgugcugacacagaccacuaagggcgacgggagcacacgcggacacaaggcuaccgucuacacggguucugcccccuuuaccccuaaauugggcuccgugcaguucucaacagacacugaaaacgauuuugagacccaucaaaauacaaaguucacuccagucggggugauccaggacggaagcaccacacaccgaaacgaaccccagcaauggguucucccgaguuacucuggcagaaaugugcacaacguacaucuggccccugcagucgcuccaaccuuucccggugagcaguuacuguucuuuagguccacuaugccuggguguagcggcuaucccaauauggaucucgacugccuucugccacaggagugggugcagcacuucuaccaagaagcggccccugcacagucggauguugcuuugcuacgguuugugaaccccgacacgggacguguccuguucgaguguaaacuccauaagucuggcuaugugacaguagcccacaccgggcagcacgaucuggugaucccaccgaacggauacuuucgcuucgacuccuggguuaaucaguucuauacucuugcaccuauggguaacggcaccgggagaaggcgguga

SEQ ID NO: 20641 - RNA, 1617 nt, Artificial Sequence
  derived and/or modified sequence opt3 from VP1__Norovirus_and/or_Norovirus-like__HM802527
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucucagguagucggaauuacaccaugaaccucgcaagccugaauuggaacaauuaugacccgacggaagagauucccgcuccucuugggacuccagauuucguaggaaagauccagggcguucugacacagaccacuaagggcgacgggucuacacgcggacacaaggccaccguguacacggguuccgcucccuuuaccccuaaauugggcucaguccaguucagcacagacacugaaaacgauuuugagacccaucaaaauacaaaguucacuccagugggggucacccaggacggaaguacaacccaccgaaacgaaccccagcaaugggugcucccgucuuacuccggcagaaauguucacaacgugcaucuggccccugcaguagccccaacuuuucccggugagcaguuacuguucuuuaggagcacgaugccuggguguucgggcuaucccaauauggaucucgacugccuucugccacaggaguggguccagcacuucuaccaagaagcugcgccugcacagucugauguggccuugcuacgguuuguuaaccccgacacaggacgugugcuguucgaguguaaacuccauaaguccggcuaugucaccguggcucacacugggcagcacgaucugguaaucccaccgaacggauacuuucgcuucgacucaugggugaaucaguucuauacccuugccccuauggguaacggcacagggagaaggcgguga

SEQ ID NO: 20642 - RNA, 1617 nt, Artificial Sequence
  derived and/or modified sequence opt3 from VP1__Norovirus_and/or_Norovirus-like__GQ856448
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagagauguucacaaugugcaucuggccccugcaguagcuccaaccuuucccggugagcaguuacuguucuuuagguccacuaugccuggguguagcggcuaucccaacauggaccucgauugccuucugccacaggaguggguccagcacuucuaccaagaagcggccccugcacagucggacguggcuuugcuacgguuuguuaaucccgauacgggacgugugcuguucgaguguaaacuccauaagucuggcuaugucacaguggcccacaccgggcagcacgaccugguaauuccaccgaacggauacuuucgcuucgauuccugggugaaccaguucuauacucuugcaccuauggguaauggcaccgggagaaggcgguga

SEQ ID NO: 20643 - RNA, 1617 nt, Artificial Sequence
  derived and/or modified sequence opt3 from VP1__Norovirus_and/or_Norovirus-like__AB541347
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacgggacuacaccaugaaucucgcuagucugaacuggaauaacuaugauccgacggaagagauucccgccccucuugggacuccagacuucguaggaaagauccagggcguucugacacagaccacuaagggcgacgggagcacacgcggacacaaggcuaccguguacacggguucuguccccuuuaccccuaaauugggcuccgugcaguucucaacagauacugaaaaugacuuugagacccaucaaaacacaaaguucacuccagucggggugauccaggauggaagcaccacacaccgaaaugaaccccagcaauggguucucccgaguuacucuggcagaaacgugcacaauguacaucuggccccugcagucgccccaaccuuucccggugagcaguuacuguucuuuagguccacuaugccuggguguagcggcuaucccaacauggaccucgauugccuucugccacaggagugggugcagcacuucuaccaagaagcugcgccugcacagucggacguugccuugcuacgguuugugaaucccgauacgggacguguccuguucgaguguaaacuccauaagucuggcuaugugacaguagcucacaccgggcagcacgaccuggugauuccaccgaacggauacuuucgcuucgauuccuggguuaaccaguucuauacucuugccccuauggguaauggcaccgggagaaggcgguga

SEQ ID NO: 20644 - RNA, 1617 nt, Artificial Sequence
  derived and/or modified sequence opt3 from VP1__Norovirus_and/or_Norovirus-like__AB541298
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucaccccucccacuguggagucccggacaaaaccauucaccguaccuaucuuaacgguggaagagaugacuaacucucgcuuucccauaccacuggagaaacuuuucaccggacccagcggugccuucgucgugcagccucagaauggcagauguacaacugacgggguuuugcugggaaccacacagcuauccccagugaacauuugcaccuuuaggggcgaugucacgcauaucgcagguucacggaauuacacuaugaaccucgcuagucugaauuggaacaauuaugacccgacagaagagauucccgccccucuugggaccccagauuucgugggaaagauccaaggcguacugacucagacaaccaagggcgacgggagcacgcgcggacacaaggcuaccguuuacacagguucugcccccuuuacuccuaaauugggcuccgugcaguucucaaccgacacagaaaacgauuuugaggcacaucagaauacuaaguucaccccagucggggugauccaagacggaagcacaacccaccgaaacgaaccccagcaguggguccucccgaguuacucuggcagaaaugugcaaaacguucaccuggccccugcuguggcgccaacuuuucccggugagcaguuacuguucuuuagguccacgaugccuggguguagcggcuaucccaauauggaucucgacugccuucugccacaggaguggguacagcauuucuaccaagaagcagccccugcucagucggauuuggcccuacugcgguuugucaaccccgacacaggacguguucucuucgaguguaaacugcacaagucuggcuaugugaccguggcacauacugggcagcacgaucuugucauuccaccgaacggauacuuucgcuucgacuccugggugaaucaguucuauacccuggccccuauggguaacggcacagggagaaggcgguga

SEQ ID NO: 20645 - RNA, 1617 nt, Artificial Sequence
  derived and/or modified sequence opt3 from VP1__Norovirus_and/or_Norovirus-like__AB541270
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuaugucacaguggcccacaccgggcaguacgaucugguaauuccaccgaacggauauuuucgcuucgacuccugggugaaucaguucuacacucuugcaccuauggguaacggcaccgggagaaggcgguga

SEQ ID NO: 20646 - RNA, 1617 nt, Artificial Sequence
  derived and/or modified sequence opt3 from VP1__Norovirus_and/or_Norovirus-like__AB541263
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacgugugcaccuuuaggggagauguaacacauauugcaggcagucggaauuacaccaugaaccucgcuagccugaauuggaacaauuaugacccgacggaagagauccccgccccucuugguacuccagauuucguugggaagauucagggagugcugacacagaccacuaagggcgacggcucuacacgcgggcacaaggcuaccgucuacacgggauccgcccccuuuaccccuaaauuggguucagugcaguucagcacagacacugaaaacgauuuugagacccaucaaaauacaaaguucacuccagucggcgugauccaggacgggggaaccacacaccgaaacgaaccccagcaauggguucucccgaguuacucuggcagagaugugccuaauguacaccuggcaccagccgucgcucccaccuuuccuggugagcaguuacuguucuuuagguccacuaugcccggguguagcggcuauccaaacauggaccucgauugccuucugccucaggagugggugcagcauuucuaccaagaagcggcacccgcccagucggacguugcuuugcuacgguuugugaauccagauacgggacguguccuguucgaguguaaacuccacaagucuggcuaugugacaguagcccauaccgggcagcacgaccuggugaucccgccuaacggauacuuucgcuucgauuccuggguuaaccaguucuauacucuugcacccauggguaauggcaccgggagaaggcgguga

SEQ ID NO: 20647 - RNA, 1617 nt, Artificial Sequence
  derived and/or modified sequence opt3 from VP1__Norovirus_and/or_Norovirus-like__AB541256
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcugcccugaauuggaacaauuaugacccgacggaagagauucccgcuccucuugggacuccagauuucguaggaaagauccagggcguucugacacagaccacuaagggcgacgggaguacacgcggacacaaggccaccguguacacggguagcgcagacuuuacccccaaauugggcucuguccaguucuccacagauacugaaaacgacuuugagacccaucaaaauacaaaguucacuccugugggggucauccaggauggaucaaccacacaccgaaacgaaccacagcaaugggugcuccccagcuacaguggcagaaauguucacaacgugcaucuggccccggcuguagcgccuaccuuuccaggugagcaguuacuguucuuuaggucuacuaugcccggguguuccggcuauccuaauauggaccucgauugccuuauuccccaggaguggguccagcacuucuaccaagaagcagccccagcucagagcgacguggcccuguugcgguuuguuaacccugauacgggacgugugcuauucgaguguaaacugcauaagucgggcuaugucacaguggcacacaccgggcagcacgaccucguaauacccccaaacggauacuuucgcuucgauucuugggugaaucaguucuauacucuggccccgauggguaacggcgcugggagaaggcgguga

SEQ ID NO: 20648 - RNA, 1617 nt, Artificial Sequence
  derived and/or modified sequence opt3 from VP1__Norovirus_and/or_Norovirus-like__AB541240
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccagugagauccuuuggagcgcuccucuggggccagauuugaaucccuacuuaucccaccuggcccggauguauaacggauacgcgggcgguuucgaagugcaggucauucuagcagggaaugccuuuacagcuggaaaaaucauuuucgccgcagugccuccaaacuuuccgacugagggccucucucccucgcagguaacgauguucccucauaucauaguugacgugcgccaacuggagccaguccuuaucccccugccugaugugcgaaauaacuuuuaucacuacaaucagucaaacgacagcaccauuaaguugaucgcuaugcucuauacaccacugcgugccaacaaugcgggcgaagauguguucacugucaguugcagaguucugaccaggcccuccccggacuuugauuucauuuuucucgugccucccacaguagagucucggaccaaaccauucacugugccuaucuuaacagucgaagagaugaccaacagccgcuuucccauaccacuggagaaacuuuucacggggcccuccucagccuucgugguucagccucagaauggaagauguacuaccgacgguguguugcugggcacaacucaacuaaguccagucaacauuugcaccuuuaggggagaugugacacauaucgcagggagccggaauuacaccaugaaccucgcuucuauuaauuggaacaauuaugacccgacggaagagauccccgccccucugggcacuccagauuucguagguaagauccaggggguucuuacacagaccacuaagggagacggcuccacacgcggccacaaggcuaccguguacacggggucagcccccuuuaccccuaaacugggaagcguccaguucaguacagacacugaaaacgauuuugagacccaucaaaauacaaaguucacuccagugggugucauucaggacggcgggaccacacaccagaacgaaccccaacaguggguguugccgggauacucuggccgaaauguuccuaacgugcaccucgcaccagccguagcucccaccuuuccuggugagcagcuguuauucuuuagauccacuaugcccggguguagcggcuauccaaauauggaucuggacugccuccuuccucaggaguggguccaacauuucuaccaggaagcggcacccgcccagucggauguggcucuguugagguuuguuaacccagacacgggacgggugcuauucgaguguaaacugcacaagucuggcuaugucacaguggcccauaccgggcagcacgaucucguaauaccgccuaacggauacuuucguuucgacuccugggugaaucaauucuauacucuggcacccauggguaacggcaccgggcgcagaagguga

SEQ ID NO: 20649 - RNA, 1617 nt, Artificial Sequence
  derived and/or modified sequence opt3 from VP1__Norovirus_and/or_Norovirus-like__AB541233
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacauggaucucgacugccuucugccucaggaguggguccagcauuucuaccaagaagcggcacccgcccagucugauguggcuuugcuacgguuuguuaauccagacacgggacgugugcuguucgaguguaaacuccacaaggccggcuaugucacaguggcacauaccgggcagcacgaucugguaauuccgccuaacggauacuuucgcuucgacuccugggugaaccaguucuauacucuugcccccauggguaauggcaccgggagaaggcgguga

SEQ ID NO: 20650 - RNA, 1617 nt, Artificial Sequence
  derived and/or modified sequence opt3 from VP1__Norovirus_and/or_Norovirus-like__AB541215
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagaucccuuggagugaaccacuuggacccgaucugaauccuuacuugagccacuuagcucggauguauaacggcuacgccgguggguucgaggugcaggucauucuggcgggaaaugcauuuacagccggcaaaaucauuuucgcugccgugccaccgaacuuucccacugagggccuauccccuucucagguaacgauguucccacauaucauaguugacgugcgccaacucgaacccguccugaucccucuuccagaugugcgaaauaacuuuuaucacuacaaucagucgaacgacucaaccauuaagcugaucgcaauguuguauacaccccuccgugcuaacaaugccggggaggauguguucacugucagcugcagaguucugaccaggccgaguccugacuuugauuucauuuuucuggugcccccaacaguagaaucccggaccaaaccuuucacugugcccauccucacagucgaggagaugaccaacucucgcuuuccaauacccuuagaaaagcuguucacgggaccuagcuccgcguucgugguucagccacagaaugguagauguacuaccgacggcgugcuuuuggggacaacucaacugucaccggucaacauuugcaccuuuaggggagaugugacacauaucgccggcagucggaauuacaccaugaaccuagcaagccucaauuggaacaauuaugaccccacggaggaaauuccugcuccacuggguacucccgauuucguagggaaaauccagggaguucuuacacagaccacuaagggcgacggcucuacacgcgggcacaaggccaccguguacacgggauccgcugacuuuaccccuaaacuggguucaguccaguucagcacagauacugagaacgacuuugaaacccaucaaaauacaaaguucacuccagugggcgucauccaggaugggggaaccacacaccgaaacgagccccagcaauggguguugccgaguuacucuggcagaaauguucacaacgugcaucucgccccugcaguagccccaaccuuucccggugagcagcuguuauucuuuagguccacuaugccuggguguagcggcuaucccaauauggaccuggauugccuccuuccacaggaauggguccagcacuucuaccaagaggcugcgccugcacagucggacguggcccuguugcgguuuguuaaccccgauacgggacgugugcuauucgaauguaaacugcauaagucuggcuaugucacaguggcucacaccgggcagcacgaccucguaauuccaccgaacggauacuuucgcuucgauuccugggugaaucaguucuauacucuggccccuauggguaacggcaccgggagaaggcgguga

SEQ ID NO: 20651 - RNA, 1617 nt, Artificial Sequence
  derived and/or modified sequence opt3 from VP1__Norovirus_and/or_Norovirus-like__AB541201
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgucagacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugagacccaucaaaacacaaaguucacuccagugggggucauccaggacggaaguaccacacaccgaaaugaaccccagcaaugggugcucccgucuuacuccggcagaaacguucacaaugugcaucuggccccugcaguagcuccaaccuuucccggugagcaguuacuguucuuuaggagcacuaugccuggguguucgggcuaucccaacauggaucucgacugccuucugccacaggaguggguccagcacuucuaccaagaagcggccccugcacagucugauguggcuuugcuacgguuuguuaaucccgacacgggacgugugcuguucgaguguaaacuccauaaguccggcuaugucacaguggcccacaccgggcagcacgaucugguaauuccaccgaacggauacuuucgcuucgacucaugggugaaccaguucuauacucuugcaccuauggguaauggcaccgggagaaggcgguga

SEQ ID NO: 20652 - RNA, 1617 nt, Artificial Sequence
  derived and/or modified sequence opt3 from VP1__Norovirus_and/or_Norovirus-like__FJ411172
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggagcaacuacgauccgacugaggaaauucccgccccucuggguacaccagacuuuguagggaagauccagggaaugcuuacccagacuacacgaagagacggcucuaccaggggccacaaagcuacgguucugaccggguccgccgauuucgcacccaaguugggacgggugcaauuugccacagacacugauaaugacuucgagucaggugaaaacaccaaguuuacaccugucggcgugauccaggaugggagcacuacccaucguaaugagccacagcaauggguccuccccaacuacaguggacgcacaggccacaaugugcaccuggcuccggcgguugcaccuaccuauccaggugaacaguuacuguucuuuagaucuacuaugcccggguguuccggcuacccuaacauggaccucgauugccuucugccccaggagugggugaggcauuucuaucaggaggccgcuccagcccaaagcgacguagcauugcuacgguuugucaauccugauacgggacgagugcuguucgaauguaaacuccacaagucgggcuacguuacaguggcccauaccgggcagcacgaccuggucauucccccaaacggauauuuucgcuucgauucuugggugaaccaguuuuacacucuugcuccgauggguaauggcgccgggagaaggcgguga

SEQ ID NO: 20653 - RNA, 1617 nt, Artificial Sequence
  derived and/or modified sequence opt3 from VP1__Norovirus_and/or_Norovirus-like__AB447449
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacgggacuacaccaugaaucucgcuagucugaacuggaauaacuaugauccgacggaagagauucccgccccucuugggacuccagacuucguaggaaagauccagggcguucugacacagaccacuaagggcgacgggagcacacgcggacacaaggcuaccguguacacggguucugcccccuuuaccccuaaauugggcuccguccaguucucaacagauacugaaaaugacuuugagacccaucaaaacacaaaguucacuccagugggggucauccaggauggaagcaccacacaccgaaaugaaccccagcaaugggugcucccgaguuacucuggcagaaacguucacaaugugcaucuggccccugcaguagcuccaaccuuucccggugagcaguuacuguucuuuagguccacuaugccuggguguagcggcuaucccaacauggaccucgauugccuucugccacaggaguggguccagcacuucuaccaagaagcggccccugcacagucggacguggcuuugcuacgguuuguuaaucccgauacgggacgugugcuguucgaguguaaacuccauaagucuggcuaugucacaguggcccacaccgggcagcacgaccugguaauuccaccgaacggauacuuucgcuucgauuccugggugaaccauuucuauacucuugcaccuauggguaauggcaccgggagaaggcgguga

SEQ ID NO: 20654 - RNA, 1617 nt, Artificial Sequence
  derived and/or modified sequence opt3 from VP1__Norovirus_and/or_Norovirus-like__AB447431
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugacgaacucucgcuuucccauaccacuggagaaacuuuucacuggacccagcuccgcguucgugguucagccucagaaugguagauguaccacagauggcguguugcuggggacuacccaacuaucaccagucaacauuugcacauuuaggggagacgugacccauaucgccggcagucggaauuacacgaugaaccucgcaagccugaauuggaacaauuaugauccgacugaggaaauucccgcuccucuugguacaccagacuucguagggaagauccagggaguucugacccagacuacaaagggcgacggcucuacccgcgggcacaaggccacgguguacaccggauccgcucccuuuacaccuaaauuggguucaguccaguucagcacugauaccgagaacgacuuugaaacacaucaaaauacuaaguucaccccagugggcgucauccaggaugggggaacaacccaccgaaacgagccccagcaaugggugcucccgaguuacucuggcagaaauguucacaacgugcaucuggccccugcaguagccccaacuuuucccggugaacaguuacuguucuuuagguccacgaugccuggguguagcggcuaucccaauauggaccucgauugccuucugccacaggaguggguccagcacuucuaccaagaggcugcgccugcacagucggacguggccuugcuacgguuuguuaaccccgauacaggacgugugcuguucgaauguaaacuccauaagucuggcuaugucaccguggcuuacacugggcagcacgaccugguaauuccaccgaacggauauuuucgcuucgauuccugggugaaucaguucuacacccuugccccuauggguaacggcacagggagaaggcgguga

SEQ ID NO: 20655 - RNA, 1617 nt, Artificial Sequence
  derived and/or modified sequence opt3 from VP1__Norovirus_and/or_Norovirus-like__EU078415
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccucauucgugguucagccacagaacgguagauguaccacagauggcguguugcuggggacuacccaacuaaguccggucaauauuugcacauuuaggggagacgugacccauaucgcgggcacgcagaacuacacuaugaaucucgccagccagaacuggaauaacuaugaucccacagaggaaauuccugcaccacuggguacccccgacuucguagggaagauccagggaguucuuacucaaacaacccggggcgacggcucuacgcgcgggcacaaggcuaccguguccacaggaucaguccauuuuacuccuaagcuggguagcgugcaguucaguaccgauacaucuaaugacuuugagacuggccagaacacccgauucacaccagucggggugguucaagauggauccaccacucaccagaaugaaccccagcaguggguguugccggacuacagcggcagaaacucgcacaauguacaucucgccccugcugucgccccaacguuucccggugagcaacuguuauucuuuaggucuacaaugccuggguguuccggcuaccccaacaugaaucuggauugccuccuuccacaggaaugggugcagcacuucuaucaggagucagccccugcacaaagugacguugcucuguugcgguuugugaaccccgauaccggacguguccuauucgaguguaaacugcauaagagcggcuacgugacuguagcgcacaccgggcagcacgaccucgugaucccaccgaacggauauuuucgcuucgauuccuggguuaaucaguucuacacacuggcaccuauggguaacggcgccgggagaaggcgguga

SEQ ID NO: 20656 - RNA, 1617 nt, Artificial Sequence
  derived and/or modified sequence opt3 from VP1__Norovirus_and/or_Norovirus-like__AB385643
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaugaucguugacgugcgccaacuggagccaguccuuauaccccugccugaugugcgaaacaauuuuuaucacuacaaccagucaaaugacccaacaaucaaguugauugcaaugcucuauacuccccugcgugcuaacaacgccggggaugacguguucaccgucagcugcagaguucugacaaggccgaguccugauuuugacuucaucuuucucgugcccccaaccguagaaucccggacuaaaccuuucucugugcccauuuuaacagucgaggaaaugaccaauagccgcuuuccaaucccccuggagaaacuuuucacgggaccuuccucagcguucgugguucagccacagaacgguagauguacuaccgauggcguguugcuggggacaacucaacuaaguccggucaauauaugcaccuuuaggggagacgugacacauauugccggcacccaggaguacacgaugaaccucgcaagccagaauuggaacaauuaugaucccacugaagagaucccugcuccacuggguacacccgacuucguagggaagauucagggaguucuuacccaaacuacacggggcgacggcucuacccgcgggcacaaggccacgguguccaccggaucaguccauuuuacaccuaagcugggucgaauccaguucagcacugauaccaguaacgacuuugaaacaggccagaauacuagauucaccccagugggggucgugcaagauggaucuacaacccaccagaacgagccccagcaguggguuuugccgaauuacuccggcagggacagccacaacgugcaucucgcuccugccguagcaccaucguuucccggugaacaacuguuauucuuucggucuacuaugccuggguguuccggcuaccccaauaugaaccuggauugccuccuuccacaggaguggguccagcacuucuaucaggaggccgcuccugcgcaaucagacguggcacuguugcguuuuguuaaucccgauacgggacgcgugcuauucgaauguaaacugcauaagaguggcuacgucacaguggcccacaccgggcagcacgaccucguaaucccaccgaacggauauuuuagauucgauagcugggugaaccaguucuacacucuggcuccuauggguaauggcaccgggaggcggcgauga

SEQ ID NO: 20657 - RNA, 1617 nt, Artificial Sequence
  derived and/or modified sequence opt3 from VP1__Norovirus_and/or_Norovirus-like__AB385636
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagauucaugcagaguccugaccaggccgagcccugacuuugauuucauuuuucucguucccccaacuguggaaagucggacaaaaccuuucuccguacccaucuuaaccguggaggaaaugaccaauucucgcuuuccaauaccccuggagaaacuuuucacuggaccuagcuccgcguucgucgugcagccacagaacgguagauguaccacagacggcguuuugcuggggacuacccaacuaucaccggugaauauuugcacauuuaggggagaugucacccauaucgccggcacgcagaacuacacuaugaaucucgcaagucagaacuggaauaacuaugaccccacagaggaaauuccugcuccacuggguacccccgacuucguggggaagauccagggaguacuuacucaaacaacccggggcgauggcagcacgcgcgggcacaaggccaccguuucuacaggauccgugcauuuuacuccuaagcuggguucaguccaguucagcaccgacacaaguaaugauuuggagacuggccagaacacccgauuuacaccagugggggucgugcaagacggaucuaccacucaccagaaugaaccccagcaguggguucucccgaacuacuccggcagagauagccacaaugugcaucuggcuccugccguagcaccaacguuccccggugagcaauuacuguuuuucaggucgacaaugccuggguguucuggcuaccccaacaugaaucucgacugccuucugccacaggaauggguccagcacuuuuaucaggaguccgccccugcucaaucagauguggcguugcuacgguucguuaaccccgacaccggacgugugcuguuugaguguaaacuccauaagaguggcuacgucacuguggcacacaccgggcagcacgaucugguaaucccaccgaacggauauuuccgcuuugacagcugggugaaucaguucuacacacuugccccuauggguaacggcgcugggagaaggcgguga

SEQ ID NO: 20658 - RNA, 1617 nt, Artificial Sequence
  derived and/or modified sequence opt3 from VP1__Norovirus_and/or_Norovirus-like__AB385629
augaagauggccagcaacgacgcuacccccuccgauggcucuacagcaaaucuggugccugaggucaacaaugaaguuauggcccucgagccaguggcgggggcugccaucgcagccccgguagcuggacagcaaaacgugauugaccccuggauaagaaauaacuucguccaggcaccugguggcgaauuuacugugucaccaaggaaugcccccggggagauccuuuggagugcuccucugggaccagauuugaaccccuacuuaagccaccuggcccggauguauaauggcuacgcggguggguucgaaguucaggugauucuagcaggaaacgccuuuacggcuggcaaaaucauuuucgccgcagucccuccaaauuuuccgaccgagggccucucccccucucaggugacaauguucccucauaucauaguagacguucgccaacuggagccagugcuuaucccccugccugauguccgaaacaauuuuuaucacuacaaccagucgaaugacccaacuauuaaguugaucgcuaugcucuauacgccccugcgugccaacaacgcgggggaugacguguucacagugucaugcagaguccugaccaggccgagcccugauuuugacuucauuuuucucguucccccaacuguggaaagucggacaaaaccuuucuccguacccaucuuaaccguggaggaaaugaccaauucucgcuuuccaauaccccuggagaaacuuuucacuggaccuagcuccgccuucgucgugcagccacagaacgguagauguaccacagauggcguuuugcuggggacuacccaacuaucaccggugaauauuugcacauuuaggggagacgucacccauaucgcaaacacgcagaauuacacuaugaaccucgcuagucagaauuggaacaauuaugaucccacagaggaaauuccugccccacugggcacccccgacuucgugggucggauccaggggguacuuacucaaacaacccgcggagacggcagcacgcgaggccacaaggcuaccguuucuacaggguccgugcauuuuacuccuaagcugggaucaguccaguucagcaccgauacaaguaacgacuuggagacuggucagaauaccagauuuacaccagugggcgucgugcaagaugggggaaccacucacaggaacgaaccccagcaguggguucucccggacuacucuggccgggauucccacaaugugcaucuggccccugcaguagccccaacguuccccggugagcaguuacuguuuuuccguagcacaaugccuggguguucgggcuaccccaacaugaaucucgacugccuucugccacaagaauggguccagcacuuuuaucaggagucugcuccugcgcaguccgauguggcauugcuacgcuucguuaaccccgacaccggaagagugcuguuugaguguaagcuccauaaaucaggcuacgucacuguggcccacaccgggcaacacgaucugguaaucccaccgaacggauauuucagguuugacaguugggugaaucaguucuacacacuugcuccuauggguaacggcgccgggcggcgacgcuga

SEQ ID NO: 20659 - RNA, 1617 nt, Artificial Sequence
  derived and/or modified sequence opt3 from VP1__Norovirus_and/or_Norovirus-like__EU839586
augaagauggccagcaacgacgcuucccccucugauggcucaaccgcaaaucuggugccugaggucaacaaugaaguuauggcccucgagccagugguaggggcggcuaucgccgcaccggugacaggacagcaaaacgucauugaccccuggauaagaaauaacuucgugcaggccccugguggcgaauuuacuguuaguccaaggaaugcucccggggagauccuuuggagcgcaccucugggaccagauuugaaccccuacuuaucccaccuggcccggauguauaauggcuacgcugguggguucgaagugcaggucauucuagccggaaacgcguuuacggcaggcaaaaucauuuucgccgcugugccuccaaauuuuccgaccgagggccucucucccucgcagguaacaauguucccucauaucauaguugacgugcgccaacuggagccaguccuuaucccccugccugaugugcgaaacaauuuuuaucacuacaaccagucaaaugacagcacuauuaaguugaucgccaugcucuauaccccacugcgugcaaacaacgcuggggaugacguguucacagucaguugcagaguucugaccaggcccuccccggauuuugacuucauuuuucucgugccucccacuguagaaucucggacaaaaccauucaccgugccuaucuuaacggucgaggaaaugacuaauagccgcuuucccauaccacuggagaaacuuuucaccggacccuccucagccuucgugguucagccucagaacgguagauguacaacugauggcguguugcuggggaccacacaacuaaguccagucaauauuugcaccuuuaggggagacgugacgcauaucccgggcacucggacauaccgcaugaaccucgcgagccagaauuggaacaauuaugaucccaccgaggaaauuccugccccacuggguacucccgacuucguagggaagauccagggaaugcuuacacagaccacgaagggcgacggcucuacccgagggcacaaggcaacaguuuccacuggaucaguggauuuuaccccuaaacuggguagcguccaauucgcuacagacacugauaacgacuuugagaccggccagaauacaagauucaccccagugggggucauccaggauggaaguucuacucauaggaacgaaccccaacaguggguguugccggacuacuccggccggacggcccacaauguucaccucgcuccugccguggcaccaacauuucccggugagcagcuguuauucuuucguagcaccaugccuggguguucgggcuaccccaacauggaucuggacugccuccuuccacaggaauggguacaacauuucuaucaggaggccgcuccuucucaguccgaugucgcgcuguugcgcuuugugaaucccgacacuggaagaguucuauucgaguguaagcugcacaaagcaggcuacgugaccgucgcccauacagggcagcacgaucucgugauuccaccgaacggauauuuuagguucgacucauggguaaaucaauucuacacccuggcuccuauggguaacggcgccgggcggcgacgcuga

SEQ ID NO: 20660 - RNA, 1617 nt, Artificial Sequence
  derived and/or modified sequence opt3 from VP1__Norovirus_and/or_Norovirus-like__EU310927
augaagauggccagcuccgacgcuucucccucagauggcaguaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucacagugcccaucuuaaccgucgaggaaaugacgaacagccgcuuuccaauaccccuggagaaacuuuucacuggaccuuccggugcguucgugguucagccacagaauggcagauguaccacagaugggguguugcugggaacuacccaacuaucaccggucaacauuugcacauuuaggggcgacgugacccauaucgccgguacgcacgauuacacuaugaaucucgcaagucagaacuggaauaacuaugaccccacagaggaaauuccugcuccacuggggacccccgacuucguaggaaagauccagggcguucuuacucagacaacccggggcgaugggagcacgcgcggacauaaggccaccgugucuacagguuccguccacuuuacuccuaagcugggcucagugcaauucaccacagacacuaauaacgauuuggagaccgggcagaauacaaaauuuaccccagucggagugguucaggacggcaacagcgcucaccaaaaugaaccccagcagugggugcucccgaacuacaguggucgaacugggcauaauguacaccuggccccugcagucgccccaacguuccccggcgagcaguuacuguuuuucagaucuacaaugccuggauguuccggcuaccccaacaugaaucucgauugccuucugccacaagaauggguguugcauuuuuaucaggaggcugcgccugcacagagcgacguugcccuacugagguucgugaaccccgauaccgggcggguccucuuugaguguaagcugcacaaaucgggauacgugacuguagcucacaccgguccacaugaccuugugaucccgccuaacggcuauuuccguuuugauucuuggguuaaucaguucuacacacuggcccccauggggaacggagcaggccgcagaagguga

SEQ ID NO: 20661 - RNA, 1617 nt, Artificial Sequence
  derived and/or modified sequence opt3 from VP1__Norovirus_and/or_Norovirus-like__AB294787
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucacugugccuaucuuaacagucgaggaaaugaccaauagccgcuuucccauaccacuggagaaacuuuucacgggacccuccucagccuucgugguucagccucagaacgguagauguacuaccgauggcguguugcuggggacaacucaacuaaguccagucaauauuugcaccuuuaggggagacgugacacauaucagcggcacccggacguaccgcaugaaccucgcaucucagaauuggaacaauuaugauccgacugaggaaauucccgcuccucuggguacaccagacuucguagggaagauccagggaaugcuuacccagacuacaaagggcgacggcuccacccgagggcacaaggccacgguuucaaccggaagcguggauuuuacacccaaacuggguaguguccaauucgcuacugacaccgauaacgacuuugagacaggccagaauacuagauucaccccugugggggucauccaggauggaucuuccgcccauaggaacgaaccacaacaguggguguugcccgacuacagcggccggacaguucacaaugugcaccucgcaccggccguagcuccuaccuuuccaggugagcagcuguuauucuuucguucgacuaugcccggguguucuggcuacccuaacauggaucuggacugccuccuuccccaggaauggguccaacauuucuaucaggaggcggcaccaucccagucagauguggcccuguugcgcuuuguuaauccugacacgggaagagugcuauucgaguguaagcugcacaaagcuggcuacgucacaguggcccauaccgggcagcacgaucucguaauucccccaaacggauauuuuagguucgacaguugggugaaucaauucuacacucuggcaccgauggguaacggcgccgggcggcgacgcuga

SEQ ID NO: 20662 - RNA, 1617 nt, Artificial Sequence
  derived and/or modified sequence opt3 from VP1__Norovirus_and/or_Norovirus-like__AY587987
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcgccuuuaggggcgaugugacacauaucgcagguacccacaauuacacgaugaaccucgcuucccagaauuggaacaauuaugaccccacugaagagauuccugccccacuggggacacccgauuucguaggacggauccagggcaugcuuacccagacuacacgcggcgacgggucaacccgaggacauaaggcuacgguuaguaccggugacgugcacuuuacaccuaagcugggcagcauccaauucaacacugauaccaauaacgacuuugaaacagggcagaauacuaaguucaccccagucggagugguccaggauggcaacgguacacaccaaaaugagccccagcaguggguguugccgucuuacuccgggagaaccggccauaacguucaccucgccccugcaguggccccaacuuuucccggagaacagcuguuauucuuuaggucaacgaugccuggcuguagcggguaccccaacaugaaucuggacugccuccuuccacaagaguggguacagcauuucuaucaggaggcugcgccugcacagagugaugucgcccuguugcgguuugugaaccccgacacaggacguguucuauucgaauguaaacugcacaagucugguuacgugaccgucgcucacacuggccaacaugaucucgugauuccaccgaauggguauuuucgcuucgacuccuggguaaaccaguucuacacccuggccccuaugggaaauggcacagguagaaggcgguga

SEQ ID NO: 20663 - RNA, 1617 nt, Artificial Sequence
  derived and/or modified sequence opt3 from VP1__Norovirus_and/or_Norovirus-like__AY502019
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucguguucgcugccguaccuccaaacuuuccgacggagggccucucccccucucagguuaccauguucccucauauuaucguggacguccgccaacuggagccagugcuuauaccccugccugaugugcgaaauaacuuuuaucacuacaaucagucgaacgacccaacaaucaaguugauugcaaugcucuauacuccccugcgugcuaacaaugccggggaagaugucuucaccguuucaugcagagugcugacaaggccgagcccugacuuugauuucaucuuucucguacccccaaccguggagagucggacuaaaccuuucacaguccccauuuuaaccguggaagagaugacgaacucccgcuuuccaaucccccuggagaaacuuuucacuggaccuucuagcgcguucguugugcagccacagaaugguagauguaccacagacggcgucuugcuggggacuacccaacuauccccggugaacauaugcacauuuaggggagauguaacccauauugccggcacgcacaauuacacuaugaaccucgcaucacagaauuggaacaauuaugaccccacagaagagaucccugcuccacuggguacccccgauuucguugggcggauucagggaaugcuuacucagacaacccgcggcgacggcaguacgcgagggcauaaggccaccgugagcacaggagacguccacuuuacuccuaagcuggguucuauccaauucaacaccgauacaaauaacgacuuugaaacuggccagaauaccaaguucacaccagugggggucgugcaggauggaaacggcacccaccaaaaugagccccagcaguggguuuugccguccuacucagguagaacugggcauaacgugcaccucgcuccugccguagcaccaacguuucccggcgaacagcuguuauucuuuaggagcacaaugccuggauguaguggcuaccccaacaugaaucuggacugccuccuuccacaagaguggguccagcauuucuaucaggaggccgcuccugcgcagucugauguggcacuguugcgguuuguuaaccccgacaccgggcgugugcuauucgaauguaaacugcacaaguccggauacgucacuguggcccacaccggucaacaugaucucguaaucccaccgaauggcuauuuucgcuucgacagcugggugaaccaguucuacacacuggcuccuauggggaauggaaccggcagaaggcgguga

SEQ ID NO: 20664 - RNA, 1617 nt, Artificial Sequence
  derived and/or modified sequence opt3 from VP1__Norovirus_and/or_Norovirus-like__LC177653
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucguguucgccgcaguaccuccaaacuuuccgacugagggccucucccccucucagguuacgauguucccucauauuaucguggacguccgccaacuggagccagugcuuauaccccugccugaugugcgaaauaacuuuuaucacuacaaucagucgaacgacucaaccaucaaguugauugcuaugcucuauacaccacugcgugccaacaaugcgggggaagaugucuucacuguuagcugcagagugcugaccaggcccaguccggacuuugauuucaucuuucucguaccucccacaguggagucccggaccaaaccauucacugucccuauuuuaacaguggaagagaugaccaacucucgcuuucccaucccacuggagaaacuuuucacgggacccagcggugccuucauaguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugaggcacaucaaaauaccaaguucacaccagugggggucauccaggacggaggcacuacccaccgaaacgaaccccagcaaugggugcucccgagcuacagugguagagauguucacaaugugcaucuggccccugcuguagcgccaacauuucccggggagcaguuacuguucuuuaggucuaccaugccuggcuguuccggauaucccaacauggaccucgauugccuucugccacaggaguggguccagcacuucuaccaagaagcagccccugcucagagcgacguggccuugcuacgguuuguuaaucccgauacuggccgugugcuguucgaguguaaacuccauaagucgggguaugucacgguggcacacacaggacagcacgaccugguaauuccaccgaacgguuacuuucgcuucgauucuugggugaaccaguucuauacccuugccccuaugggcaaugggacuggaagaaggcgguga

SEQ ID NO: 20665 - RNA, 1617 nt, Artificial Sequence
  derived and/or modified sequence opt3 from VP1__Norovirus_and/or_Norovirus-like__AB972486
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucgcaacagacacugaaaacgauuuugagacccaucaaaauacaaaguucacuccagucggcgugauccaggacgggggaaccacacaccgaaacgaaccccagcaauggguccucccgagcuacaguggcagaaaugugccuaacguucaccuggccccagcuguggcgcccaccuuuccuggugagcaguuacuguucuuuaggucuacuaugcccggguguuccggcuauccaaauauggaucucgacugccuucugccucaggaguggguacagcauuucuaccaagaagcagcccccgcucagagcgaugucgccuugcuacgguuugugaacccagacacgggacguguucuguucgaguguaaacuccacaagucgggcuaugugacagucgcacauaccgggcagcacgaucuggugauuccgccuaacggauacuuucgcuucgacucuuggguaaaucaguucuauacucuugcccccauggguaacggcaccgggagaaggcgguga

SEQ ID NO: 20666 - RNA, 1617 nt, Artificial Sequence
  derived and/or modified sequence opt3 from VP1__Norovirus_and/or_Norovirus-like__KR904235
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcacuccucugggaccagauuugaaccccuacuuaucccaccuggcccggauguauaauggcuacgcugguggguucgaagugcaggucauucuagccggaaacgcguuuacggcaggcaaaaucauuuucgccgcugugccuccaaauuuuccgaccgagggccucucucccucgcagguaacaauguucccucauaucauaguugacgugcgccaacuggagccaguccuuaucccccugccugaugugcgaaacaauuuuuaucacuacaaccagucaaaugacccaacuauuaaguugaucgccaugcucuauacaccccugcgugcaaacaacgcuggggaugacguguucaccgucagcugcagaguucugaccaggccgaguccugauuuugacuucauuuuucucgugcccccaacuguagaaucccggacaaaaccuuucucugugcccgucuuaaccguggaggaaaugacgaauagccgcuuuccaaucccccuggagaaacuuuucacuggaccuuccucagccuucguugugcagccacagaacgguagauguaccacagauggcgucuugcuggggacuacccaacuaaguccggugaauauaugcacauuuaggggagacguaacccauauuagcggcucucggaacuacacgaugaaucucgcgucccagaacuggaacucauaugaucccacugaggaaaucccugccccacuggguacacccgacuucguugggaagauucagggagugcuuacccagacuacacgcaccgacggcagcacgcgaggccacaaggcaaccgucuacacagggagugcugauuuuucuccuaagcugggaagagugcaauucgccacugacaccgauaaugacuuugagacaaaucagaacacuaaauucaccccagucggugugauccaggauggcuccacaacccauaggaaugaaccccaacaguggguuuugccgagcuacucggggcggaacacucacaaugugcaccucgcuccugccguagcaccaacguuucccggagagcagcuguuauucuuucguucuacaaugccuggcuguuccgguuaucccaacauggaccuggauugccuccuuccacaggaauggguccaauacuucuaucaggaggccgcuccugcgcagucagacguggcacuguugcgcuuuguuaaucccgauaccgggagagugcuauucgaguguaagcugcauaaaaguggcuacgucacuguggcccacaccggacagcaugaccucguaaucccaccgaacggcuauuuuagguucgauagcugggugaaccaauucuacacacuggcuccuauggggaauggaaccggucggcgacgcuga

SEQ ID NO: 20667 - RNA, 1617 nt, Artificial Sequence
  derived and/or modified sequence opt3 from VP1__Norovirus_and/or_Norovirus-like__AB933753
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucaacuuucgugguucagccacagaacgguagauguaccacagauggcguguugcuggggacuacccaacuaaguccggucaauauuugcacauuuaggggagacgugacccauaucgcgggcagccggaacuacacgaugaaucucgccucucagaacuggaacuccuaugaucccacugaggaaauuccugcaccacuggguacacccgacuucguagggaagauccagggaguucuuacccagacuacacgcaccgacggcucaacgcgaggccacaaggcuaccguguacacagggagcgccgauuuuaguccuaagcugggaagaguccaauucgcuacugacaccgauaaugacuuugaugccaaucagaacacaaaauucacuccagugggugucauccaggacggcgggaccgcacauaggaaugagccccaacaguggguguugccgucuuacuccggacggaacacacacaauguucaccucgccccugcuguggcgccaaccuuucccggcgaacagcuguuauucuuucguagcacuaugccugguuguucgggguaucccaacauggaucuggacugccuccuuccacaggaguggguacaauacuucuaucaggaagcagccccugcucagucugaugucgcccuguugcgcuuugugaaucccgacacgggcagaguucuauucgaguguaagcugcauaaauccggauacgugacagucgcacacaccggccagcaugaucucgugauuccaccgaacggguauuuuagguucgacucauggguaaaccaauucuacacucuggccccuaugggaaaugguaccggccggcgacgcuga

SEQ ID NO: 20668 - RNA, 1617 nt, Artificial Sequence
  derived and/or modified sequence opt3 from VP1__Norovirus_and/or_Norovirus-like__AB933721
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccugucuuaacaguggaagagaugaccaacucucgcuuucccaucccacuggagaaacuuuucacgggacccagcuccgccuucguugugcagccucagaaugguagauguacuaccgacggcgucuugcuggggacaacucaacuaucaccagugaacauaugcaccuuuaggggagauguaacacauauugcaggcagucggaauuacaccaugaaccucgcuagccugaauuggaacaauuaugacccgacggaagagauccccgccccucuugguacuccagauuucguugggaagauucagggaaugcugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguuccuaacgugcaccuggcaccagccguagcucccaccuuuccuggcgagcaguuacuguucuuuaggagcacuaugcccgguuguucgggguauccaaauauggaucucgacugccuucugccucaggaguggguccagcauuucuaccaagaagcggcacccgcccagucugauguggcuuugcuacgguuuguuaacccagacacgggccgugugcuguucgaguguaaacuccacaaguccggauaugucacaguggcccauaccggccagcacgaucugguaaucccgccuaacggguacuuucgcuucgacucaugggugaaucaguucuauacucuugcacccaugggaaacgguaccggcagaaggcgguga

SEQ ID NO: 20669 - RNA, 1617 nt, Artificial Sequence
  derived and/or modified sequence opt3 from VP1__Norovirus_and/or_Norovirus-like__AB933706
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcuccgccuucgugguucagccucagaaugguagauguacuaccgacggcuugcugcuagggacaacucaacucucaccagugaacauuugcaccuuuaggggagaugucacacauaucgcaggcagucggaauuacaccaugaaccuggcuagccuuaauuggaacaauuaugacccgacggaagagauucccgccccucuggguacuccagauuucguggggaaaauccagggaauguugacacagaccacuaagggcgacggcucuacacgcgggcacaaggcuaccguauacacgggauccgcccccuuuaccccuaaacucgguucaguucaguucagcacagacacugaaaacgauuuugagacccaucaaaauacaaaguucacuccagugggcgucauccaggacgggaguaccacacaccgaaacgaaccccagcaaugggugcugccgucuuacuccggaagaaaugucccuaacgugcacuuagcaccagccguugcucccaccuuuccuggcgagcagcuucucuucuuuaggagcacuaugcccgguuguucgggguauccaaauauggaucuugacugccuguugccucaggagugggugcagcauuucuaccaagaagcggcacccgcccagucugauguagcucuacugcgguuugucaacccagacacgggccguguucucuucgaguguaaacugcacaaguccggauaugugacaguggcccauaccggccagcacgaucuugucauuccgccuaacggguacuuucgcuucgacucaugggugaaucaguucuauacucuggcacccaugggaaacgguaccggcagaaggcgguga

SEQ ID NO: 20670 - RNA, 1617 nt, Artificial Sequence
  derived and/or modified sequence opt3 from VP1__Norovirus_and/or_Norovirus-like__AB933669
augaagauggccagcaacgacgcuaccgcauccgauggcucugccgcgaaucuggugcccgaggucaacaaugaaguuauggcucucgagccugugguaggggccgcaaucgccgcuccaguggcaggacagcaaaacgucauugacccguggauaagaaauaacuucgugcaggcccccgguggcgaauuuacaguuucaccuaggaaugcuccaggggagauccuuuggagugcaccccugggaccugauuugaacccauacuuaagccaccuggcgcggauguauaauggcuacgccgguggguucgaagugcaggucauucuagccggaaacgcuuuuacugccggcaaaaucauuuucgcagcugugcccccuaauuuuccaaucgagggccucuccccgucucagguaacgauguucccccauauaaucguugacgugcgccaacuggagccuguccuuauuccacugcccgaugugcgaaacaauuuuuaucacuacaaccagucgaaugacucaaccaucaaguugauugccaugcucuauacaccucugcgugcgaacaacgccggggaagauguguucacugucagcugcagaguucugaccaggccaagucccgacuuugauuucaucuuucucgugccgccuacaguagagucccggaccaaacccuucacugugccaauauuaacagucgaagagaugaccaauucucgcuuuccuauuccccuggagaaacuuuucacgggaccaagcuccgcauucgugguucagccccagaacgguagauguacuaccgacggcguguugcuggggacaacucaacuaucaccugucaauaucugcaccuuuaggggagaugugacacauauugcuggcagucggaacuacaccaugaaucucgccagccugaacuggaauaacuaugacccaacggaagagaucccggcuccccuugguacuccugauuucguagggaagauccagggaguucugacacagaccacuaagggcgacggcucuacacgcgggcacaaggccaccguguacacgggauccgcaccauuuacccccaaauuggguucaguccaguucagcacagacacugaaaaugauuuugagacccaucaaaacacaaaguucacuccugugggcgucauucaggacgggggaaccacacaccgaaaugaaccacagcaaugggugcuccccaguuacucuggcagaaacguuccgaaugugcaccuggccccugcuguagcgccaaccuuucccggugagcaguuacuguucuuuagguccacuaugccuggguguagcggcuaucccaacauggaucucgacugccuucugccacaggaguggguccagcauuucuaccaagaagcagccccugcucagucggauguggccuugcuacgguuuguuaaucccgacacgggacgugugcuguucgaguguaaacuccacaagucuggcuaugucacaguggcacauaccgggcagcacgaucugguaauaccaccgaacggauacuuucgcuucgacuccugggugaaccaguucuauacucuugccccuauggguaauggcaccgggagaaggcgguga

SEQ ID NO: 20671 - RNA, 1617 nt, Artificial Sequence
  derived and/or modified sequence opt3 from VP1__Norovirus_and/or_Norovirus-like__EU921350
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcacccaggaguacacgaugaaccucgcaagccagaauuggaacaauuaugaucccacugaagagauuccugcuccacuggguacacccgacuucguagggaagauccagggaguucuuacccaaacuacacggcgcgacggcucuacccgaggccacaaggccacgguguccaccgggucaguccauuuuacaccuaagcugggaagaauccaguucagcacugauaccaguaacgacuuugaaacaggucagaauacuagguucaccccagugggcgucgugcaagaugggucuacaacccaccagaacgagccccagcagugggcuuugccggacuacuccggacgggauagccacaauguucaucucgccccugcaguggccccaucguuucccggcgaacaacuguuauucuuucguucuacuaugccugguuguuccggguaccccaacaugaaucuggacugccuccuuccacaggaguggguacagcacuucuaucaggaggcugcgccugcacaaucagaugucgcccuguugcgcuuugugaaccccgacacgggcagaguucuauucgaauguaaacugcauaagaguggauacgugacagucgcucacaccggccagcacgaucucgugauuccaccgaauggguauuuuagguucgacagcuggguaaaccaguucuacacucuggccccuaugggaaacgguaccggccggcgacgcuga

SEQ ID NO: 20672 - RNA, 1617 nt, Artificial Sequence
  derived and/or modified sequence opt3 from VP1__Norovirus_and/or_Norovirus-like__LC005712
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccaucuacacgggauccgcccccuuuaccccuaaauuggguucagugcaguucagcacagacacugaaaacgauuuugagacccaucaaaauacaaaguucacuccagucggcgugauucaggacgggggaaccacacaccgaaacgaaccccagcaauggguccucccgaguuacucuggcagagaugugccuaauguucaccuggcaccagccguggcucccaccuuuccuggugagcaguuacuguucuuuagguccacuaugcccggguguagcggcuauccaaacauggaccucgauugccuucugccucaggaguggguacagcauuucuaccaagaagcggcacccgcccagucggacgucgcuuugcuacgguuugugaauccagauacgggacguguucuguucgaguguaaacuccacaagucuggcuaugugacagucgcccauaccgggcagcacgaccuggugauaccgccuaacggauacuuucgcuucgauuccuggguaaaccaguucuauacucuugcacccauggguaauggcaccgggagaaggcgguga

SEQ ID NO: 20673 - RNA, 1617 nt, Artificial Sequence
  derived and/or modified sequence opt3 from VP1__Norovirus_and/or_Norovirus-like__LC018707
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcuaauuuuagcccuaagcugggaagagugcaauucgagacagauacugaccaugauuuugaaguuaaccagaauaccaaauucacaccaguggguguaauccaggacggcaguacuacccacaggaacgagccccaacagugggucuugccgucuuacuccgggcggaauacaccuaacgugcaccucgccccagcaguugcccccaccuuuccuggagaacagcuguuauucuuucguagcacuaugcccggcuguucggguuauccaaauauggaucuggacugccuccuuccucaggagugggugcaauacuucuaucaggaggcugcgcccgcacagucugaugucgcccuguugcgcuuugugaacccagacacggggagaguacuauucgaauguaagcugcauaaauccggcuacgugacaguugcucacaccggacagcaugaucucgucauuccgccuaacggcuauuuuagguucgacucaugggugaaucaauucuacacucuggcccccauggggaacggaaccggucggcgacgcuga

SEQ ID NO: 20674 - RNA, 1617 nt, Artificial Sequence
  derived and/or modified sequence opt3 from VP1__Norovirus_and/or_Norovirus-like__KM982955
augaagauggccagcuccgacgcuacccccucugauggcucagcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuacaguuaguccaaggaacgcccccggggagauccuuuggagcgcuccucugggaccagauuugaaucccuacuuaucccaccuggcccggauguauaacggcuacgcggguggguucgaagugcaggucauucuagcaggaaaugccuuuacugcuggcaaagugaucuucgccgcaguaccuccaaacuuuccgacggagggccucucucccucgcagguuaccauguucccucauauuguggucgacgugcgccaacuggagccagugcuuaucccccugccugauguccgaaauaacuuuuaucacuacaaucagucaaacgacccaacaauaaaguugaucgcuaugcucuauacuccccugcgugccaauaacgcgggggaugacguuuucaccgugagcugcagaguacugacaaggccgaguccugauuuugacuucauuuuucucgugcccccaaccgucgaaucccggacuaaaccuuucucugugcccguuuuaacaguggaggaaaugaccaacagccgcuuuccaaucccccuggagaaacuuuucacgggaccuuccucagccuucgucgugcagccacagaaugguagauguacuaccgauggcguauugcuggggacaacucaacuaaguccgguuaacauuugcaccuuuaggggagacgugacacauaucaccggcagccacaauuacacgaugaaccucgcaucucagaauuggaacaauuaugaucccacugaggaaauaccugcuccacuggguacacccgacuucgucgggaagauucagggagugcuuacccagacuacacggaccgacggcuccacgcgcggccauaaggccaccgucuacacagggucagcugauuuugccccuaagcugggacgagugcaauucgagacugacaccaaccacgauuuugaagcaaaucagaacacaaaauucacuccaguuggugugauccaggacggcagcaccacacacagaaaugagccccaacaguggguauugccgaguuacucugggaggaacacccauaauguccaccucgccccugcuguggcgccaacuuuucccggagaacagcuguuauucuuucgguccacgaugccuggcuguagcgguuaucccaacauggaucuggacugccuccuuccacaggaguggguucaauacuucuaucaggaggcagccccugcucagucggauguggcccuguugcguuuugucaaucccgacacagggcgcgugcuauucgaauguaagcugcauaaaucuggcuacguaaccguggcacacacuggacagcacgaucucguuauuccaccgaacggcuauuuuagauucgacuccugggucaaccaauucuacacccuggccccuauggggaauggaacagguaggcggcgauga

SEQ ID NO: 20675 - RNA, 1617 nt, Artificial Sequence
  derived and/or modified sequence opt3 from VP1__Norovirus_and/or_Norovirus-like__KM982949
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacaucacccauauaacaggcagccggaacuacaccaugaaucucgcaucucagaacugguccaauuaugaucccacggaggaaauuccugcuccacuggguacucccgacuucguggggaagauccagggaguccuuacacagaccacucgcacagacggcucaacccgaggccacaaggccacgguguacaccgggagcgcugauuuugccccuaagcugggaagaguccaauucgguacagacacugaucaugacuuugaggcaaaccagaauaccaaauucacaccagugggcguuauucaggaugggaguacuacccacaggaacgaaccccaacaguggguguugccgucuuacuccggacggaauacaccuaacguacaccucgccccagcugucgcgcccaccuuuccuggcgagcagcuguuauucuuucguagcacuaugcccgguuguucgggguauccaaauauggaccuggauugccuccuuccucaggaaugggugcaauacuucuaucaggaggcagcccccgcucagucugacguugcccuguugcgcuuugugaacccagauacgggcagaguccuauucgaguguaagcugcauaaauccggauacgugacaguagcacacaccggccagcaugaccucgugaucccgccuaauggguauuuuagguucgauucauggguuaaccaauucuacacucuggcccccaugggaaacgguaccggccggcgacgcuga

SEQ ID NO: 20676 - RNA, 1617 nt, Artificial Sequence
  derived and/or modified sequence opt3 from VP1__Norovirus_and/or_Norovirus-like__KM406485
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaagugaucuucgccgcaguaccuccaaacuuuccgacugagggccucucccccucucagguuacgauguucccucauauuguggucgacgugcgccaacuggagccagugcuuaucccccugccugauguccgaaauaacuuuuaucacuacaaucagucgaacgacccaaccauaaaguugaucgcuaugcucuauacaccccugcgugccaacaaugcgggggaugacguuuucacugugucaugcagaguacugaccaggccgagcccugauuuugacuucauuuuucucgugcccccaacagucgaaagucggaccaaaccuuucuccgugcccguuuuaacuguggaggaaaugacaaacucucgcuuuccaaucccccuggagaaacuuuucaccggaccuagcuccgccuucgucgugcagccacagaaugguagauguacgacugauggcguauugcuggggaccacacaacuaucaccgguuaacauuugcacuuuuaggggagacgugacccauaucacaggcagucggaauuacaccaugaaccucgcaagccagaauuggaacaauuaugaucccacggaggaaauaccugcuccacuggguacucccgacuucgucgggaagauucagggagugcuuacacagaccacucgcacagacggcucuacccgaggccacaaggccacggucuacaccggguccgcugauuuugccccuaagcugggaagagugcaauucgagacagacacugaucaugacuuugaagcaaaccagaauaccaaauucacaccaguuggugugauccaggauggcucaacuacccacaggaacgagccccaacaguggguauugccgagcuacagugggcggaauacaccuaacguccaccucgccccagcuguggcgcccaccuuuccuggagaacagcuguuauucuuucguucuacuaugcccggcuguuccgguuauccaaauauggaccuggauugccuccuuccucaggaguggguucaauacuucuaucaggaggcagcccccgcucagagcgacguggcccuguugcgcuuugucaacccagauacggggagagugcuauucgaauguaagcugcauaaaucgggcuacguaacaguggcacacaccggacagcaugaccucguuauuccgccuaacggcuauuuuagguucgauucuugggucaaucaauucuacacucuggcccccauggggaacggaaccggucggcgacgcuga

SEQ ID NO: 20677 - RNA, 1617 nt, Artificial Sequence
  derived and/or modified sequence opt3 from VP1__Norovirus_and/or_Norovirus-like__KM198574
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacgggacuacacgaugaaccucgcuagucugaauuggaacaauuaugauccgacugaagagauucccgccccucuugggacaccagacuucguaggaaagauccagggcguucugacccagacuacaaagggcgacgggagcacccgcggacacaaggcuacgguguacaccgguucugcccccuuuacaccuaaauugggcuccguccaguucucaacugauaccgaaaacgacuuugagacacaucaaaauacuaaguucaccccagugggggucauccaggauggaggcacaacccaccgaaacgaaccccagcaaugggugcucccgagcuacagugguagagacguucacaaugugcaucuggccccugcaguagcuccaacuuuucccggggagcaguuacuguucuuuaggucuacgaugccuggcuguuccggauaucccaacauggaucucgacugccuucugccacaggaguggguccagcacuucuaccaagaagcggccccugcacagagcgauguggcuuugcuacgguuuguuaaucccgacacaggccgugugcuguucgaguguaaacuccauaagucgggguaugucaccguggcccacacuggacagcacgaucugguaauuccaccgaacgguuacuuucgcuucgacucuugggugaaucaguucuauacccuugcaccuaugggcaacgggacaggaagaaggcgguga

SEQ ID NO: 20678 - RNA, 1617 nt, Artificial Sequence
  derived and/or modified sequence opt3 from VP1__Norovirus_and/or_Norovirus-like__KM198517
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagauuaaugacccaaccaucaaguugauugcuaugcucuauacaccccugcgugccaacaacgcgggggaagauguguucacugucucaugcagaguucugaccaggccgagcccugacuuugauuucaucuuucucgugcccccaacaguagagagucggaccaaaccuuucacugugcccauauuaacagucgaagagaugaccaauucccgcuuuccaauuccccuggagaaacuuuucacgggaccuucuggugccuucgugguucagccacagaacggcagauguacuaccgacgggguguugcugggaacaacucaacuaagcccggucaauaucugcaccuuuaggggcgaugugacacauauugcagguucccggaacuacaccaugaaucucgcuucacugaacuggaauaacuaugaccccacggaagagaucccugccccacuugggacucccgauuucguaggaaagauccagggcguucugacacagaccacuaagggcgacgggaguacacgcggacacaaggcuaccguguacacggguagcgccccuuuuaccccaaaauugggcucuguccaguucuccacagacacugaaaaugauuuugagacccaucaaaacacaaaguucacucccgugggggucauucaggacggaucaaccacacaccgaaaugaaccgcagcaaugggugcucccuagcuacaguggcagagauauacacaacguucaucuggcaccagccguggcucccaccuuuccuggugagcaguuacuguucuuuaggucuacuaugcccggguguuccggcuauccaaauauggaccucgauugccuucugccucaggaguggguacagcacuucuaccaagaagcggcacccgcccagagcgacgucgcuuugcuacgguuugugaacccagauacgggacguguucuguucgaguguaaacuccauaagucgggcuaugugacagucgcccacaccgggcagcacgaccuggugaucccgccuaauggauacuuucgcuucgauucuuggguaaaccaguucuauacucuugcacccauggguaacggcaccgggagaaggcgguga

SEQ ID NO: 20679 - RNA, 1617 nt, Artificial Sequence
  derived and/or modified sequence opt3 from VP1__Norovirus_and/or_Norovirus-like__JX439839
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccacaacuacaccaugaaucucgcuucucugaacuggaauaacuaugacccgacggaagagauucccgccccucuugguacuccagauuucguagggaagauccagggaguucugacacagaccacuaagggcgacggcuccacacgggggcauaaggcuaccguguacacgggaucagcccccuuuaccccuaaauuggguagcguccaguucaguacagacacugaaaaugauuuugagacccaccaaaacacaaaguucacuccagugggcgucauccaggacgggggaaccacacaccgcaaugaaccccagcaaugggugcucccgucuuacuccggccgaaacguuccuaaugugcaucuggcaccagccguagcucccaccuuuccuggugagcaguuacuguucuuuagaagcacuaugcccggguguucgggcuauccaaacauggaucucgacugccuucugccucaggaguggguccagcacuucuaccaagaagcggcacccgcccagucugauguggcuuugcuaagguuuguuaauccagacacgggacgggugcuguucgaguguaaacuccauaaguccggcuaugucacaguggcccacaccgggcagcacgaucugguaauuccgccuaacggauacuuucguuucgacucaugggugaaccaguucuauacucuugcacccauggguaauggcaccgggcgcagaagguga

SEQ ID NO: 20680 - RNA, 1617 nt, Artificial Sequence
  derived and/or modified sequence opt3 from VP1__Norovirus_and/or_Norovirus-like__JX439837
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcuccgcguucgugguucagccucagaaugguagauguaccacagacggcguguugcuggggacuacccaacuaucaccagucaacauuugcacauuuaggggagaugugacccauaucgccggcagucggaauuacacgaugaaccucgcaagccugaauuggaacaauuaugacccgacugaagagauucccgcuccucuugguacaccagauuucguagggaagauccagggaguucugacccagacuacaaagggcgacggcucuacccgcgggcacaaggccacgguguacaccggauccgcucccuuuacaccuaaauuggguucaguccaguucagcacugacaccgaaaacgauuuugagacacaucaaaauacuaaguucaccccagugggcgucauccaggacgggggaacaacccaccgaaacgaaccccagcaaugggugcucccgaguuacucuggcagaaauguucagaacgugcaccuggccccugcaguagccccaacuuuucccggugagcaguuacuguucuuuagguccacgaugccuggguguagcggcuaucccaauauggaucucgacugccuucugccacaggaguggguccaacauuucuaccaggaagcugcgccugcacagucggauguggccuugcuacgguuuguuaaccccgacacaggacgugugcuguucgaguguaaacuccacaagucuggcuaugucaccguggcucauacugggcagcacgaucugguaauuccaccgaacggauacuuucgcuucgacuccugggugaaucaauucuauacccuugccccuauggguaacggcacagggagaaggcgguga

SEQ ID NO: 20681 - RNA, 1617 nt, Artificial Sequence
  derived and/or modified sequence opt3 from VP1__Norovirus_and/or_Norovirus-like__KC631815
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguagguaagauccaggggguucuuacccaaacuacacggcgcgacggauccacccgaggccacaaggccacggugucaaccggcagcguccauuuuacaccuaagcuggggagaauccaguucaguacugauaccucuaacgacuuugaaacaggacagaauacuagguucaccccagugggugucgugcaagauggcuccacaacccaccagaacgagccccagcaguggguuuugccgaauuacagcgggcgggacucgcacaacgugcaucucgcuccugccguagcaccaucuuuucccggagaacaacuguuauucuuucguuccacuaugccuggcuguucagguuaccccaauaugaaccuggauugccuccuuccacaggaguggguccagcacuucuaucaggaggccgcuccugcgcaaagugacguggcacuguugcgcuuuguuaaucccgauacggggagagugcuauucgaauguaaacugcauaagagcggcuacgucacaguggcccacaccggacagcacgaccucguaauuccaccgaacggcuauuuuagguucgauuccugggugaaccaguucuacacucuggcuccuauggggaauggaaccggucggcgacgcuga

SEQ ID NO: 20682 - RNA, 1617 nt, Artificial Sequence
  derived and/or modified sequence opt3 from VP1__Norovirus_and/or_Norovirus-like__KC409315
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaagaugacuuugagacacaucaaaauacuaaguucaccccagugggggucauccaggauggaggcacaacccaccgaaacgaaccccagcaaugggugcucccgagcuacagugguagagacguucacaaugugcaucuggccccugcaguagcuccaacuuuucccggggagcaguuacuguucuuuaggucuacgaugccuggcuguuccggauaucccaacauggaucucgacugccuucugccacaggaguggguccagcacuucuaccaagaagcggccccugcacagagcgauguggcuuugcuacgguuuguuaaucccgacacaggccgugugcuguucgaguguaaacuccauaagucgggguaugucaccguggcccacacuggacagcacgaucugguaauuccaccgaacgguuacuuucgcuucgacucuugggugaaucaguucuauacccuugcaccuaugggcaacgggacaggaagaaggcgguga

SEQ ID NO: 20683 - RNA, 1617 nt, Artificial Sequence
  derived and/or modified sequence opt3 from VP1__Norovirus_and/or_Norovirus-like__KC409289
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacccaacaauuaaguugaucgcuaugcucuauacuccccugcgugccaacaacgcgggggaagauguguucaccgucucaugcagaguucugacaaggccgagcccugacuuugauuucauuuuucucgugcccccaaccguagagagucggacuaaaccuuucacagugcccaucuuaaccgucgaagagaugacuaauucccgcuuuccaauaccccuggagaaacuuuucacgggaccuucuggugccuucgugguucagccacagaacggcagauguaccacagacgggguguugcugggaacuacccaacuaagcccggucaauauuugcacauuuaggggcgaugugacccauaucgcagguucccggaacuacacgaugaaucucgcuucacugaacuggaauaacuaugaccccacugaagagguaccugccccacuugggacacccgauuucguuggaaagauucagggcgugcugacccagacuacaaagggcgacgggaguacccgcggacacaaggcuacggucuacaccgguagcgccccuuuuacaccaaaauugggcucugugcaguucuccacugacaccgaaaaugauuuugagacacaucaaaacacuaaguucacccccgucggggugauccaggacggaggcacaacccaccgaaaugaaccgcagcaauggguucucccuucauacagcgguagagaugugcacaacguacaucuggcaccagccgucgcucccacuuuuccuggggagcaguuacuguucuuuaggaguacgaugcccggcuguucuggauauccaaauauggaccucgauugccuucugccucaggagugggugcagcacuucuaccaagaagcggcacccgcccaguccgacguugcuuugcuacgguuugugaacccagauacaggccguguccuguucgaguguaaacuccauaagagcggguaugugaccguagcccacacuggacagcacgaccuggugaucccgccuaaugguuacuuucgcuucgauucguggguuaaccaguucuauacccuugcacccaugggcaacgggacaggaagaaggcgguga

SEQ ID NO: 20684 - RNA, 1617 nt, Artificial Sequence
  derived and/or modified sequence opt3 from VP1__Norovirus_and/or_Norovirus-like__KC409278
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugaggcacaucaaaauaccaaguucacaccagugggggucauccaggacggaggcacuacccaccgaaacgaaccccagcaaugggugcucccgagcuacagugguagagauguucacaaugugcaucuggccccugcuguagcgccaacauuucccggggagcaguuacuguucuuuaggucuaccaugccuggcuguuccggauaucccaacauggaccucgauugccuucugccacaggaguggguccagcacuucuaccaagaagcagccccugcucagagcgacguggccuugcuacgguuuguuaaucccgauacuggccgugugcuguucgaguguaaacuccauaagucgggguaugucacgguggcacacacaggacagcacgaccugguaauuccaccgaacgguuacuuucgcuucgauucuugggugaaccaguucuauacccuugccccuaugggcaaugggacuggaagaaggcgguga

SEQ ID NO: 20685 - RNA, 1617 nt, Artificial Sequence
  derived and/or modified sequence opt3 from VP1__Norovirus_and/or_Norovirus-like__KC175402
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggucuaccacacaccgaaaugaaccccagcaaugggugcucccguccuacagcggaagaaacguuccuaaugugcaccuggcaccagccguagcucccaccuuuccuggcgagcaguuacuguucuuuaggucgacuaugcccgguuguucuggguauccaaacauggaucucgacugccuucugccucaggaguggguccagcauuucuaccaagaagcggcacccgcccaguccgauguggcuuugcuacgguuuguuaauccagacacgggccgugugcuguucgaguguaaacuccacaagucaggauaugucacaguggcccauaccggccagcacgaucugguaauuccgccuaacggguacuuucgcuucgacaguugggugaaccaguucuauacucuugcacccaugggaaaugguaccggcagaaggcgguga

SEQ ID NO: 20686 - RNA, 1617 nt, Artificial Sequence
  derived and/or modified sequence opt3 from VP1__Norovirus_and/or_Norovirus-like__JX459616
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaggcaccacacaccgaaacgaaccccagcaaugggugcucccgagcuacagugguagaaauguucacaacgugcaucuggccccugcaguagcuccaaccuuucccggggagcaguuacuguucuuuaggucuacuaugccuggcuguuccggauaucccaauauggaucucgacugccuucugccacaggaguggguccagcacuucuaccaagaagcggccccugcacagagcgauguggcuuugcuacgguuuguuaaccccgacacgggccgugugcuguucgaguguaaacuccauaagucgggguaugucacaguggcccacaccggacagcacgaucugguaauuccaccgaacgguuacuuucgcuucgacucuugggugaaucaguucuauacucuugcaccuaugggcaacgggaccggaagaaggcgguga

SEQ ID NO: 20687 - RNA, 1617 nt, Artificial Sequence
  derived and/or modified sequence opt3 from VP1__Norovirus_and/or_Norovirus-like__JX459599
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccugucccggauguauaauggcuacgcugguggguucgaagugcaggucauucuagccggaaacgcguuuacggcaggcaaaaucauuuucgccgcugugccuccaaauuuuccgaccgagggccucucucccucgcagguaacaauguucccucauaucauaguugacgugcgccaacuggagccaguccuuaucccccugccugaugugcgaaacaauuuuuaucacuacaaccagucaaaugacccaacuauuaaguugaucgccaugcucuauacaccccugcgugcaaacaacgcuggggaugacguguucaccgucagcugcagaguucugaccaggccgaguccugauuuugacuucauuuuucucgugcccccaacuguagaaucccggacaaaaccuuucucugugcccaucuuaaccgucgaggaaaugacgaauagccgcuuuccaauaccccuggagaaacuuuucacuggaccuuccucagccuucgugguucagccacagaacgguagauguaccacagauggcguguugcuggggacuacccaacuaaguccggucaauauuugcacauuuaggggaaacgugaccaauaucgcgggcagccagacguacacuaugaaccucgccucucagaauuggaacaauuaugaccccacagaggaaauuccugcaccacuggguacccccgauuucguagggcggauccagggaguucuuacucaaacaacccgcggcgacggcuccacgcgagggcauaaggcuaccgugucaacaggaagcgccuacuuuacuccuaagcuggguaguguccaguucucuaccgacacauccacugauuuugagaccggccagaacacaagauucaccccagugggggucgugcaagacggaagcacuacgcacaagaaugaaccccagcaguggguuuugccgucguacucuggcagggauucccauaacgugcaccucgcuccugccguagcaccaacauuucccggugagcagauccuguucuuucggucaaccaugccuggguguaguggcuaucccaauauggacuuagauugccugcucccacaagaauggguccagcacuucuaccaggagagcgccccugcucaguccgacguggcgcuucugcguuuuguuaaccccgauacuggacgcguguuguucgaguguaaacuacauaagucuggcuaugucaccguggcacacacagggcaacaugaccugguaauuccaccgaauggauacuuuagauucgauagcugggugaaccaguucuauacccucgccccuauggguaacggcgcugggaggcggcgauga

SEQ ID NO: 20688 - RNA, 1617 nt, Artificial Sequence
  derived and/or modified sequence opt3 from VP1__Norovirus_and/or_Norovirus-like__JN400603
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaucaccaagggcgacggcucuacucgcgggcacaaggcuacaguguacaccggaggugcccccuuuacgccuaaauugggcuccguccaguucucaaccgacacagaaaacgauuuugagacucaucaaaauaccaaguucacaccagugggggucauucaggacggaagcacuacccaccgaaacgaaccccagcaaugggugcucccgaguuacucuggcagaaauguucacaacgugcaucuggccccugcaguagcuccaacauuucccggugagcaguuacuguucuuuagguccaccaugccuggguguagcggcuaucccaauauggaucucgacugccuucugccacaggaguggguccagcacuucuaccaagaagcggccccugcacagucggauguggcuuugcuacgguuuguuaaccccgacacuggacgugugcuguucgaguguaaacuccauaagucuggcuaugucacgguggcccacacagggcagcacgaucugguaauaccaccgaacggauacuuucgcuucgacuccugggugaaucaguucuauacccuugcaccuauggguaacggcacugggagaaggcgguga

SEQ ID NO: 20689 - RNA, 1617 nt, Artificial Sequence
  derived and/or modified sequence opt3 from VP1__Norovirus_and/or_Norovirus-like__JQ613572
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagacacuuuggagugcuccucugggaccagauuugaaucccuacuuaagccaccuggcccggauguauaacggcuacgcggguggguucgaagugcaggucauccuagcaggaaaugccuuuacugcuggcaaaauuaucuucgccgcagugccuccaaacuuuccgacggagggccucucccccucucagguaaccauguucccucauauuaucguugacgugcgccaacuggagccaguccuuauaccccugccugaugugcgaaauaacuuuuaucacuacaaucagucgaacgacucaacaaucaaguugauugcuaugcucuauacuccacugcgugccaacaaugcgggggaugacguguucaccgucagcugcagaguucugacaaggcccaguccggauuuugacuucaucuuucucgugccucccaccguagaaucccggacuaaaccauucacagugccuauuuuaaccgucgaggaaaugacgaacucucgcuuucccaucccacuggagaaacuuuucacuggacccagcuccgccuucgugguucagccucagaaugguagauguaccacagauggcguguugcuggggacuacccaacuaucaccagucaacauaugcacauuuaggggagacgugacccauauugcaggcagucggaauuacacgaugaaccucgcuagccugaauuggaacaauuaugauccgacugaggaaauccccgccccucuugguacaccagacuucguagggaagauucagggaaugcugacccagacuacacagggcgacggcucuacccgcgggcacaaggcuacgguuuacaccggauccgccgauuuuacacccaaguuggguucagugcaauucgcaacugacaccgagaacgauuuugaaacacaucagaauacuaaauucaccccugucggcgugauccaggacgggagcacaacccaccgaaacgagccacaacagugggcccuccccaguuacucuggaagauccgcucacaauguccaucuggcgccggcaguggccccuaacuuuccaggcgaacaguuacuguucuuuaggagcacuaugcccgguuguucgggguauccuaauauggaucucgacugccuucugccccaggaguggguucaacacuucuaccaggaggcugccccagcacagucugauguggccuugcuacgguuuguaaacccugacacgggccguguccuguucgaauguaagcuccauaaauccggauaugugacaguugcucacaccggccagcacgaucuggugauucccccaaacggguacuuucgcuucgacucaugggucaaucaauucuauacucuugccccgaugggaaacgguaccggcagaaggcgguga

SEQ ID NO: 20690 - RNA, 1617 nt, Artificial Sequence
  derived and/or modified sequence opt3 from VP1__Norovirus_and/or_Norovirus-like__JQ613525
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucagcacagacacugagaacgauuuugaaacccaucaaaauacaaaguucacuccugugggcgucauccaggacgggaguaccacacaccgaaacgagccacagcaaugggugcuccccucuuacuccggaagaaauguucacaacgugcaucuggcaccggccguagcuccuaauuuuccaggcgaacaguuacuguucuuuaggagcaccaugcccgguuguucgggguauccuaacauggaucucgacugccuucugccccaggaguggguccagcacuucuaccaagaggcggcaccagcccagucugauguggcuuugcuacgguuuguuaacccugacacuggccgugugcuguucgaauguaaacuccauaagcccggauaugucacgguggcccacacaggccagcacgaucugguaauuccaccgaauggguacuuucgcuucgacuccugggugaaccaguucuauacccuugcaccuaugggaaauggugccggcagaaggcgguga

SEQ ID NO: 20691 - RNA, 1617 nt, Artificial Sequence
  derived and/or modified sequence opt3 from VP1__Norovirus_and/or_Norovirus-like__JQ613510
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacgcuaugaaccucgccagccugaauuggaacaauuaugacccgaccgaagagauucccgcuccucuugguacgccagauuucguagggaaaauccagggacuguugacucagacaaccaagggcgacggcucuacucgcgggcacaaggccacaguuuacaccggauccgcacccuuuacgccuaaacucgguucagugcaguucagcaccgacacagaaaacgauuuugagacucaucaaaauaccaaguucacaccagucggcgugauccaggacgggaguacuacccaccgaaacgaaccccagcaauggguccugccgucuuacuccggaagaaaugugcacaacguucauuuagccccugcuguggcgccaacauuucccggcgagcagcuucucuucuuuaggagcaccaugccugguuguucgggguaucccaauauggaucuugacugccuguugccacaggaguggguacagcacuucuaccaagaagcagccccugcucagucugaugucgcccuacugcgguuugugaaccccgacacuggccguguucucuucgaguguaaacugcauaaguccggauaugugacggucgcacacacaggccagcacgaucuugugauuccaccgaacggguacuuucgcuucgacucauggguaaaucaguucuauacccuggccccuaugggaaacgguacuggcagaaggcgguga

SEQ ID NO: 20692 - RNA, 1617 nt, Artificial Sequence
  derived and/or modified sequence opt3 from VP1__Norovirus_and/or_Norovirus-like__GQ856450
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuccacagcuggcaaaaucauuuuugccgcagugccuccaaacuucccgacugagggccucucucccucgcagguaacgauguuuccucauaucauaguugacgugcgccaacuggagccaguccuuaucccccugccugaugugcgaaauaacuucuaucacuacaaucagucaaacgacagcaccauuaaguugaucgcuaugcucuauacaccacugcgugccaacaaugcgggggaagauguguuuacugucaguugcagaguucugaccaggcccuccccggacuucgauuuuauuuuccucgugccucccacaguagagucucggaccaaaccauuuacugugccuaucuuaacagucgaagagaugaccaacagccgcuuccccauaccacuggagaaacuuuuuacgggacccuccucagccuucgugguucagccucagaaugguagauguacuaccgacggcguguugcuggggacaacucaacuaaguccagucaacauuugcaccuucaggggagaugugacacauaucgcaggcacccacaauuacacgaugaaccucgcuagccugaauuggaacaauuaugacccgacugaagagauucccgccccucuugguacaccagauuuuguagggaagauccagggaguucugacccagacuacaaagggcgacggcucuacccgggggcauaaggcuacgguguacaccggauccgcccccuucacaccuaaauuggguucaguccaguuuagcacugacaccgaaaacgauuucgagacacaccaaaauacuaaguuuaccccagugggcgucauccaggacgggaguacaacccaccgcaacgaaccccagcaaugggugcucccgucuuacuccggaggcaauguucagaacgugcaucuggccccugcaguagcuccaacuuuccccggugagcaguuacuguuuuuccgaagcacgaugccuggguguucgggcuaucccaauauggaucucgacugccuucugccacaggaguggguccaacacuuuuaccaggaagcggccccugcacagucugauguggcuuugcuaagauucguuaaccccgacacaggaagggugcuguuugaguguaaacuccauaaguccggcuaugucaccguggcccacacugggcagcacgaucugguaauuccaccgaacggauacuuccgguuugacucaugggugaaucaauucuauacccuugcaccuauggguaacggcacagggcgucgcagauga

SEQ ID NO: 20693 - RNA, 1617 nt, Artificial Sequence
  derived and/or modified sequence opt3 from VP1__Norovirus_and/or_Norovirus-like__AB541296
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugauccauauugcagguucacggaauuacacaaugaaccucgcugcccugaauuggaacaauuaugacccgaccgaagagauccccgcuccucuugggacgccagauuucguaggaaagauccagggcguucugacucagacaaccaagggcgacgggaguacucgcggacacaaggccacaguguacaccgguagcgcagacuuuacgcccaaauugggcucuguccaguucuccaccgauacagaaaacgacuuugagacucaucaaaauaccaaguucacaccugugggggucauucaggauggaucaacuacccaccgaaacgaaccacagcaaugggugcuccccagcuacaguggcagaaauguucacaacgugcaucuggccccggcuguagcgccuacauuuccaggugagcaguuacuguucuuuaggucuaccaugcccggguguuccggcuauccuaauauggaccucgauugccuucugccccaggaguggguccagcacuucuaccaagaagcagccccagcucagagcgacguggccuugcuacgguuuguuaacccugauacuggacgugugcuguucgaguguaaacuccauaagucgggcuaugucacgguggcacacacagggcagcacgaccugguaauacccccaaacggauacuuucgcuucgauucuugggugaaucaguucuauacccuugccccgauggguaacggcacugggagaaggcgguga

SEQ ID NO: 20694 - RNA, 1617 nt, Artificial Sequence
  derived and/or modified sequence opt3 from VP1__Norovirus_and/or_Norovirus-like__AB541212
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucgggacuacaccaugaaucucgcuagccugaacuggaauaacuaugauccgacggaagagauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccgauucagcacagauacugaaaaugacuuugagacccaucagaacacaaaguucacuccagugggcgucauccaagaugggaguaccacacacagaaaugaaccccagcagugggugcucccgucuuacuccggaagggacguucacaacgugcaucuggccccugcaguagcuccaaccuuucccggcgagcaauuacuguucuuucggagcacuaugccugguuguucgggguaucccaauauggaucucgacugccuucugccacaggaguggguccagcacuucuaccaggaagcggccccugcacaaucugauguggcuuugcuacguuuuguuaaccccgacacgggccgcgugcuguucgaguguaaacuccauaagccaggauaugucacaguggcccacaccggccagcacgaucugguaauuccgccuaauggguacuuuagauucgacuccugggugaaccaguucuauacucuugcacccaugggaaacgguaccggcaggcggcgauga

SEQ ID NO: 20695 - RNA, 1617 nt, Artificial Sequence
  derived and/or modified sequence opt3 from VP1__Norovirus_and/or_Norovirus-like__AB504321
augaagauggccagcaacgacgcuaaucccuccgauggcucugcagccaaccuggugccugaggucaauaacgaaguuauggcgcucgagccagugguaggggcugccaucgcagccccgguggcuggacagcaaaauauuauagaccccuggaucagaaacaauuucguccaggcaccugguggcgaauuuaccgugucaccaaggaacgcccccggggagauucuuuggagugcuccucugggaccagauuugaaucccuacuuaagccaccuggcccggauguauaacggcuacgcggguggguucgaaguucaggugauccuagcaggaaaugccuuuacagcuggcaaaauuaucuucgccgcagucccuccaaacuuuccgacugagggccucucccccucucaggugacgauguucccucauauaaucguagacguucgccaacuggagccagugcuuauuccccugccugauguccgaaauaacuuuuaucacuacaaucagucgaacgacucaaccaucaaguugauugcuaugcucuauacaccacugcgugccaacaaugcgggggaagauguguucacugugagcugcagaguccugaccaggcccaguccggacuuugauuucaucuuucucguuccucccacaguggagucccggaccaaaccauucacuguaccuauauuaacaguggaagagaugaccaacucucgcuuucccauuccacuggagaaacuuuucacgggacccagcggugccuucgucgugcagccucagaauggcagauguacuaccgacgggguuuugcugggaacaacucaacuauccccagugaacaucugcaccuuuaggggcgaugucacacauauugcagguacccggaauuacacgaugaaccucgcuucacugaauuggaacaauuaugacccgacugaagagauccccgccccucuugggacaccagauuucgugggaaagauccagggcguacugacccagacuacaaagggcgacgggaguacccgcggacacaaggcuacgguuuacaccgguagcgcccccuuuacaccuaaauugggcucugugcaguucuccacugacaccgaaaacgauuuugagacacaucaaaauacuaaguucaccccagucggggugauucaggacggaggcacaacccaccgaaacgaaccccagcaauggguccucccgucauacagcgguagaaaugugcacaacguucaucuggccccugcaguggcuccaacuuuucccggggagcaguuacuguucuuuaggaguacgaugccuggcuguucuggauaucccaauauggaucucgacugccuucugccacaggaguggguacagcacuucuaccaagaagcggccccugcacaguccgaugucgcuuugaugcgguuugugaaccccgacacaggccguguucuauucgaguguaaacugcauaagagcggguaugugaccgucgcccacacuggacagcacgaucucgugauaccaccgaacgguuacuuucgcuucgacucguggguaaaucaguucuauacccuggcaccuaugggcaacgggacaggaagaaggcgguga

SEQ ID NO: 20696 - RNA, 1617 nt, Artificial Sequence
  derived and/or modified sequence opt3 from VP1__Norovirus_and/or_Norovirus-like__AB294785
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacucaacuauuaaguugaucgcaaugcucuauaccccacugcgugcuaacaacgccggggaugacguguucacagucagcugcagaguucugaccaggcccaguccggauuuugacuucauuuuucucgugccucccacuguagaaucccggacaaaaccauucucugugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucgccggcacgcagaacuacacuaugaaucucgcaagccagaacuggaauaacuaugauccgacagaggaaauucccgcuccucuggguaccccagacuucguagggaagauccagggaguucuuacucaaacaacccggcgcgacggcucuacgcgaggccacaaggccaccguguccacagggucaguccauuuuacucccaagcugggaagcgugcaguucaguaccgauacaucuaaugacuuugagacuggucagaacaccagauucacaccugucggcgugguucaagauggguccaccacucaccagaaugaaccacagcaguggguguugcccaacuacagcggaagggacucgcacaauguacaucucgcuccggccgucgcaccuacguuuccaggcgagcaacuguuauucuuucggucuacaaugcccgguuguuccggguacccuaacaugaaucuggauugccuccuuccccaggaaugggugcagcacuucuaucaggagucagccccagcucaaagugacguugcgcuguugcguuuugugaacccugauaccggccgcguccuauucgaguguaaacugcauaagagcggauacgugacuguagcacacaccggccagcacgaccucgugauucccccaaacggguauuuuagauucgauuccuggguuaaucaguucuacacacuggccccgaugggaaacggugcuggcaggcggcgauga

SEQ ID NO: 20697 - RNA, 1617 nt, Artificial Sequence
  derived and/or modified sequence opt3 from VP1__Norovirus_and/or_Norovirus-like__AB294780
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaaccaagggcgacgggucaacgcgcggacauaaggccaccguuaguacaggugacgugcacuuuacuccuaagcugggcagcauccaauucaacaccgauacaaauaacgacuuugaaacugggcagaauaccaaauucacaccagucggagugguccaggauggcaacgguacccaccaaaaugagccccagcaguggguguugccgucuuacuccgggcgaacuggccauaacguucaccucgcuccugccguggcaccaacguuucccggagaacagcuguuauucuuuagaucaacaaugccuggcuguagcggguaccccaacaugaaucuggacugccuccuuccacaagaguggguacagcauuucuaucaggaggccgcuccugcgcagagugaugucgcacuguugagguuugugaaccccgacaccggacggguucuauucgaauguaagcugcacaaaucugguuacgugacugucgcccacaccggccaacaugaucucgugauuccaccgaauggguauuuucguuucgacuccuggguaaaccaguucuacacacuggcuccuaugggaaauggcaccggucgcagaagguga

SEQ ID NO: 20698 - RNA, 1617 nt, Artificial Sequence
  derived and/or modified sequence opt3 from VP1__Norovirus_and/or_Norovirus-like__AB303933
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacaccccugcgugcuaacaacgccggggaagauguguucaccgucucaugcagaguucugaccaggccgagcccugacuuugauuucauuuuucucgugcccccaacuguagagagucggacaaaaccuuucaccgugcccaucuuaacggucgaagagaugacuaauucccgcuuuccaauaccccuggagaaacuuuucaccggaccuucuggugcguucgugguucagccacagaacggcagauguacaacugacgggguguugcugggaaccacacaacuaagcccggucaauauuugcaccuuuaggggcgaugugacgcauaucgccgguacucacaacuacacaaugaaucucgcaucccagaacuggaauaacuaugaccccaccgaagagauuccugcuccacuggggacucccgauuucguaggacggauccagggcaugcuuacacagaccacgcgcggcgacgggucaacccgaggacauaaggccacaguuaguacuggugacgugcacuuuaccccuaagcugggcagcauccaauucaauacagauacuaacaaugacuuugaaaccgggcagaacacaaaguucaccccagucggagugguccaggauggcaaugguacucaccaaaacgagccccagcaguggguguugccgucuuacuccgggagaacgggccauaauguucaccucgcuccugccguggcaccaacauuucccggagaacagcuguuauucuuuaggucaaccaugccuggcuguagcggguaccccaacaugaaccuggacugccuccuuccacaagaguggguacagcauuucuaucaggaggccgcuccugcgcagagugaugucgcacuguugcgguuugugaaucccgacacuggacguguucuauucgaauguaaacugcacaagucugguuaccucaccguggcccacacaggccaacaugaucuggucauuccaccgaacggguauuuucgcuucgacuccugggugaaucaguucuacacccuugcuccuaugggaaacggcacugguagaaggcgguga

SEQ ID NO: 20699 - RNA, 1617 nt, Artificial Sequence
  derived and/or modified sequence opt3 from VP1__Norovirus_and/or_Norovirus-like__AY587988
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcgccuuuaggggcgaugugacacauaucgcagguacccacaauuacacgaugaaccucgcuucccagaauuggaacaauuaugaccccacugaagagauuccugccccacuggggacacccgauuucguaggacggauccagggcaugcuuacccagacuacacgcggcgacgggucaacccgaggacauaaggcuacgguuaguaccggugacgugcacuuuacaccuaagcugggcagcauccaauucaacacugauaccaauaacgacuuugaaacagggcagaauacuaaguucaccccagucggagugguccaggauggcaacgguacacaccaaaaugagccccagcaguggguguugccgucuuacuccgggagaaccggccauaacguucaccucgccccugcaguggccccaacuuuucccggagaacagcuguuauucuuuaggucaacgaugccuggcuguagcggguaccccaacaugaaucuggacugccuccuuccacaagaguggguacagcauuucuaucaggaggcugcgccugcacagagugaugucgcccuguugcgguuugugaaccccgacacaggacguguucuauucgaauguaaacugcacaagaccgguuacgugacugucgcucacaccggccaacaugaucucgugauuccaccgaauggguauuuucgcuucgacucuuggguaaaccaguucuacacacuggccccuaugggaaauggcaccgguagaaggcgguga

SEQ ID NO: 20700 - RNA, 1617 nt, Artificial Sequence
  derived and/or modified sequence opt3 from VP1__Norovirus_and/or_Norovirus-like__KX354103
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagagacuuuucaccggaccuuccucagccuucgucgugcagccacagaacgguagguguacgacugauggcguauugcuggggaccacacaacuaaguccgguuaauauuugcacuuuucggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccauaaagccacggucuacaccgggucagcugaguuugccccuaagcugggaagagugcaauucgaaacagauacuaaucacgacuuugaggcaaaccagaauaccaaguucacaccaguuggugugauccaggauggcagcacuacccacaggaacgaaccccaacaguggguauugccgaguuacucugggcggaauacacauaacguccaccucgccccugcuguggcgccaaccuuucccggagagcagcuguuauucuuucguuccacuaugccuggcuguagcgguuaucccaauauggaccuggauugccuccuuccacaggaguggguucaauacuucuaucaggaagcagccccugcucagucggacguggcccuguugcgcuuugucaaccccgauacggggagagugcuauucgaguguaaacugcauaagucuggcuacauuacaguagcacacaccggacagcacgaccucgugaucccaccgaacggcuauuuuagguucgauuccuggguuaaucaauucuacacucuggccccuauggggaacggaaccggucggcgacgcuga

SEQ ID NO: 20701 - RNA, 1617 nt, Artificial Sequence
  derived and/or modified sequence opt3 from VP1__Norovirus_and/or_Norovirus-like__KX354048
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcagcacuacccacaggaaugagccccaacaguggguauugccgaguuacucugggcggaacacacacaauguccaucucgccccugcuguggcgccaaccuuucccggagaacagcuguuauucuuucguuccacuaugccuggcuguagcgguuaucccaacacggaccuggauugccuccuuccacaggaguggguucaauacuucuaucaggaggcagccccugcucagucggacguggcccuguugcgcuuugucaaucccgauacagggagagugcuauucgaauguaagcugcacaaaucuggcuacguaaccguggcacauacuggacagcacgaccucguuauuccaccgaacggcuauuuuagguucgauuccugggucaaccaauucuacacccuggccccuauggggaauggaacaggucggcgacgcuga

SEQ ID NO: 20702 - RNA, 1617 nt, Artificial Sequence
  derived and/or modified sequence opt3 from VP1__Norovirus_and/or_Norovirus-like__KX354047
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggaacaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacuacccacaggaacgagccccaacaguggguauugccgucuuacuccgggcggaauacacacaacguccaucucgccccugcuguggcgccaaccuuucccggagaacagcuguuauucuuucguagcacuaugccuggcuguucggguuaucccaauauggaccuggauugccuccuuccacaggaguggguucaauacuucuaucaggaggcagccccugcucagucugacguggcccuguugcgcuuugucaaccccgauacggggagagugcuauucgaauguaagcugcacaaauccggcuacguaacaguggcacauaccggacagcacgaccucguuauuccaccgaauggcuauuuuagguucgauucaugggucaaccaauucuacacucuggccccuauggggaacggagcuggucggcgacgcuga

SEQ ID NO: 20703 - RNA, 1617 nt, Artificial Sequence
  derived and/or modified sequence opt3 from VP1__Norovirus_and/or_Norovirus-like__KU985161
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuugccccuaagcugggacgagugcaauucgcaacagacacugaucacgacuuugaggccaaucagaacaccaaauucacaccaguuggugugauccaggauggcagcacuacccacagaaaugaaccccaacaguggguauugccgaguuacucugggaggaacacacauaauguccaccucgcuccugcgguggcaccaaccuuucccggagagcagcuguuauucuuucgguccacuaugccuggcuguagcgguuaucccaacauggaccuggauugccuccuuccacaggaauggguucaauacuucuaucaggaggccgcuccugcccagucggacguggcacuguugcguuuugucaaucccgauacggggcgcgugcuauucgaguguaagcugcauaaaucuggcuacguaacaguggcccacaccggacagcacgaccucguuauuccaccgaacggcuauuuuagauucgauuccugggucaaccaauucuacacucuggcuccuauggggaauggaaccgguaggcggcgauga

SEQ ID NO: 20704 - RNA, 1617 nt, Artificial Sequence
  derived and/or modified sequence opt3 from VP1__Norovirus_and/or_Norovirus-like__AB972517
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacaucacccauauaacaggcagccggaacuacaccaugaaucucgcaucucagaacugguccaauuaugaucccacggaggaaauuccugcuccacuggguacucccgacuucguggggaagauccagggaguccuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauucaggauggcaguacuacccacaggaacgagccccaacaguggguguugccgucuuacuccgggcggaauacaccuaacguacaccucgccccagcugucgcgcccaccuuuccuggagaacagcuguuauucuuucguagcacuaugcccggcuguucggguuauccaaauauggaccuggauugccuccuuccucaggagugggugcaacauuucuaccaggaggcagcccccgcucagucugacguugcccuguugcgcuuugugaacccagauacggggagaguccuauucgaauguaagcugcacaaauccggcuaugugacaguagcacauaccggacagcacgaccucgugaucccgccuaauggcuacuuuagguucgauucauggguuaaccaauucuauacucuggcccccauggggaacggaaccggucggcgacgcuga

SEQ ID NO: 20705 - RNA, 1617 nt, Artificial Sequence
  derived and/or modified sequence opt3 from VP1__Norovirus_and/or_Norovirus-like__AB972494
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaguaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcuaauuuugccccuaagcugggaagagugcaauucgagacagauacugaccaugauuuugaagcaaaccagaauaccaaauucacaccaguuggugugauccaggacggcucuacuacccacaggaacgagccccaacaguggguauugccguccuacagcgggcggaauacaccuaacguccaccucgccccagcuguggcgcccaccuuuccuggagaacagcuguuauucuuucguucgacuaugcccggcuguucugguuauccaaauauggaucuggacugccuccuuccucaggaguggguucaauacuucuaucaggaggcagcccccgcucaguccgauguggcccuguugcgcuuugucaacccagacacggggagagugcuauucgaauguaagcugcauaaaucaggcuacguaacaguggcacacaccggacagcaugaucucguuauuccgccuaauggcuauuuuagguucgacaguugggucaaccaauucuacacucuggcccccauggggaacggaaccggucggcgacgcuga

SEQ ID NO: 20706 - RNA, 1617 nt, Artificial Sequence
  derived and/or modified sequence opt3 from VP1__Norovirus_and/or_Norovirus-like__KU311163
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaggacagcaccauuaaauugaucgcuaugcucuauacaccacugcgugccaauaacgcgggggaugacguguucacugucaguugcagaguucugaccaggcccuccccggauuuugacuucauuuuucucgugccucccacaguagaaucucggaccaagccauucacugugccuaucuuaacagucgaggaaaugaccaacagccgcuuucccauaccacuggagaaacuuuucacgggacccuccaaugccuucgugguucagccucagaacgguagauguacuaccgauggcguguugcuggggacaacucaacuaucaccagucaauauuugcaccuuuaggggagacgugacacagaucgcaaguacccagacguacacuaugaaccucgcuagccugaauuggaacaauuaugauccgacagaggaaauucccgccccucuuggcgcuccagacuucauggguaagauccaggggguacugacccaaacuacacggcaggacggaucuacccgcggccauaaggccacgguuuccaccggcucagugcacuuuacacccaaauuggggagcguccgauucgauacugacaccaacaauaaccuccagccucaucaaaguacaagauuuacuccagugggagucauccaggauggugacacccaccagaaugagccccagcaaugggugcugccguguuacucuggcagggauguuaacaaugugcacuuagccccugcaguagcuccauccuuccccggggaacagcugcucuuuuuccggagcacaaugccuggaugcucgggcuaccccaacauggaccuugauugucuguugccacaggaguggguccagcauuuuuaucaagaagcggccccugcacagucugacguggcucuacugcguuucguuaaucccgauaccggucgcgugcucuuugagugcaagcugcacaaauccggguacgucacuguggcccauacgggccagcacaaccuuguaauuccaccgaacggauauuucagauuugacucaugggugaaucaguucuacacacuggcaccuaugggcaacgggaccggaaggcggcgaguuuga

SEQ ID NO: 20707 - RNA, 1617 nt, Artificial Sequence
  derived and/or modified sequence opt3 from VP1__Norovirus_and/or_Norovirus-like__KR904236
augaagauggccagcuccgacgcuaacucuucagauggcagugcagccaaucuggugcccgaggucaacaaugaaguuauggcgcucgagccugugguaggggcugccaucgcagccccaguggcuggacagcaaaacgucauugacccguggauaagaaauaacuucgugcaggcacccgguggcgaauuuaccguuagcccuaggaaugccccaggggagauccuuugguccgcuccccugggaccugauuugaacccauacuuaucucaccuggcccggauguauaauggcuacgcggguggguucgaagugcaggucauucuagcaggaaacgccuuuacagcuggcaaaaucauuuucgccgcagugcccccuaauuuuccaacugagggccucucgccgucacagguaacgauguucccccauaucauaguugacgugcgccaacuggagccuguccuuaucccacugcccgaugugcgaaacaauuuuuaucacuacaaccagagcaaugacccuaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccuaucuuaacugucgaggaaaugacaaauucccgcuuucccauaccacuggagaaacuuuucaccggacccucaagugccuucgugguucagccucagaacgguagauguacgacugauggcguguugcuggggaccacacaacuaagcccagucaauauuugcacuuuuaggggagacgugacccauaucacaggcucucggaacuacaccaugaaucucgcaacgcagaacuggaacuccuaugauccgacugaggaaauucccgcuccucuggguacaccagacuucguagggaagauccagggaguucuuacccagacuacaaagaccgacggcucaacgcgcggccacaaggccaccguguacacagggagcgcugauuuugcccccaaacugggacgaguccaauucgcaacugacaccgauaaugacuuugaggccaaucagaacacaaaguucacuccugugggugucauccaggauggcgggaccacacauagaaaugaaccacaacaguggguguugcccaguuacucuggaaggaacacccacaauguucaccucgcuccggcgguggcaccuacuuuuccaggcgagcagcuguuauucuuucgguccacgaugcccgguuguagcggguauccuaacauggaccuggauugccuccuuccccaggaauggguacaauacuucuaucaggaggccgcuccagcccagucggacgucgcacuguugcguuuugugaauccugauacaggccgcguucuauucgaguguaaacugcauaagucuggauacgugaccgucgcccacacuggcccccaugaccucgugauuccaccgaacggguauuuuagauucgauuccuggguaaaccaguucuacacccuggcuccuaugggaaaugguacaggcaggcggcgauga

SEQ ID NO: 20708 - RNA, 1617 nt, Artificial Sequence
  derived and/or modified sequence opt3 from VP1__Norovirus_and/or_Norovirus-like__KR904225
augaagauggccagcuccgacgcuaaccccucugagggcucaaccgcaagucuggugccugaagucaauaacgagguuauggcccucgaaccaguggcgggggcugccaucgcagccccgguagcuggacaggugaaugucauugaucccuggauaagaaacaauuucgugcaagcaccugguggcgaguuuacaguuagcccaaggaacgcccccggggaaauccuuugguccgcuccucugggaccagacuugaaucccuacuuaucucaccuggcccggauguauaacggcuacgcggguggguucgaggugcaggucauucuagcaggaaaugccuuuacugcuggcaaaaucauuuucgccgcagugccuccaaacuuuccgacggagggccucucgcccucacagguaaccauguucccucauaucauaguugaugugcgccagcuggaaccaguccuuaucccccugccugacgugcgaaauaacuuuuaucacuacaaucaaagcaacgagccaacaauuaaguugguggcuaugcucuauacuccccugcgugccaauaacgcgggggaugacgucuucaccguuaguugcagagugcugacaaggccguccccugauuuugacuucaucuuucucguacccccaaccguggaaucucggacuaaaccuuucagcguccccauuuuaacaguggaggagaugaccaacucccgcuuuccaaucccccuggaaaaacuuuucacgggaccuucaaguagcuucguugugcagccacagaaugguagauguacuaccgauggcgucuugcuggggacaacucagcuaucuccggugaacauaugcaccuuuaggggagacguaacacauauuuccggcucacggaaucacaccaugaaccucgccagccaaaauuggaacaguuacgaucccacggaggaaaucccugcaccacuggguacucccgacuucguugggaagauucagggagugcuuacacagaccacucgcucugauggcuccacacgaggccauaaggcuaccgucuauacggggagcgccgacuuuucgccuaagcugggaagaauccaguucgcuaccgacacagauaaugacuuugagacuaaccaaaauaccaaauucacaccagugggugucauccaggauggcgggacuacccacaggaacgaaccccagcaauggguguugccgacauacucuggacggaauacccacaacguucaucucgccccugcaguggccccaacuuuucccggcgagcagcuguuauucuuucguuccacgaugccugguuguucaggguaccccgacauggaucuggacugccuccuuccacaggaguggguacagcacuucuaucaagaagcugcgccugcacagagugaugucgcccuguugcgcuuugugaaucccgacacaggcagaguucuauucgaguguaagcugcauaaagcuggauacgugaccgucgcccacacuggccagcacgaucucgugauuccaccgaacggguauuuuagguucgacagcuggguaaaucaguucuuuacccuggcaccuaugggaaacgguacaggccggcgacgcuga

SEQ ID NO: 20709 - RNA, 1617 nt, Artificial Sequence
  derived and/or modified sequence opt3 from VP1__Norovirus_and/or_Norovirus-like__LC005710
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuacauuaaccgucgaagagaugacgaacucucgcuuucccaucccacuggagaaacuuuucacuggacccagcuccgccuucgugguucagccucagaaugguagauguaccacagacggcguguugcuggggacuacccaacuaucaccagucaacauaugcacauuuaggggagaugugacccauauugcaggcagucgggacuacacgaugaaucucgcuagccugaacuggaauaacuaugauccgacugaagagauccccgccccucuugguacaccagacuucguagggaagauucagggaguucugacccagacuacaaagggcgacggcucuacccgcgggcacaaggcuacgguguacaccggauccgcccccuuuacaccuaaauuggguucaguccgauucagcacugauaccgaaaaugacuuugagacacaucagaacacuaaguucaccccagugggcgucauccaagaugggaguacaacccacagaaaugaaccccagcagugggugcucccgucuuacuccggaagggacguucacaacgugcaucuggccccugcaguagcuccaacuuuucccggcgagcaauuacuguucuuucggagcacgaugccugguuguucgggguaucccaauauggaucucgacugccuucugccacaggaguggguccagcacuucuaccaggaagcggccccugcacaaucugauguggcuuugcuacguuuuguuaaccccgacacaggccgcgugcuguucgaguguaaacuccauaaguccggauaugucaccguggcccacacuggccagcacgaucugguaaucccaccgaauggguacuuuagauucgacucaugggugaaccaguucuauacccuugcaccuaugggaaacgguacaggcaggcggcgauga

SEQ ID NO: 20710 - RNA, 1617 nt, Artificial Sequence
  derived and/or modified sequence opt3 from VP1__Norovirus_and/or_Norovirus-like__LC018709
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacaggagaaucccggaccaaaccuuucucuguccccguguuaacuguugaggaaaugacaaauagccgcuuuccaaucccccuggagaaacuuuucaccgguccuuccucagccuucgugguccagccacagaacggcagauguacgacugaugggguguugcugggaaccacacaacuaaguccgguaaauauuugcacuuuuaggggcgacguuacccauacaaccgguagccacaacuacacgaugaaucucgcaucucagaacuggaauaacuaugaucccacugaggaaaucccugcuccacuggggacacccgacuucgugggaaagauacagggcaugcuuacccagacuacacggaccgacggcuccacgcgcgggcauaaggccaccgucuacacaggaucagcugauuuugccccuaagcugggucgagugcaauucggcacugacaccgaucacgacuuggaggcaaaucagaacacaaaauuuacuccagucggggugauucaggauggaagcaccacacacagaaaugaaccccaacaguggguucucccgaguuacucuggcaggaacaccccuaaugugcaucuggccccagcuguagcgcccacuuucccuggugagcaguuacuguuuuuccgguccacgaugcccggguguagcggcuauccaaacauggaccucgauugccuucugccucaggaauggguccaauacuuuuaucaggaggcagcccccgcucagucggacguggccuugcuacguuucguuaauccagauacaggacgcgugcuguuugaguguaagcuccacaaaucuggcuacgucaccguggcacauacugggcagcacgaccugguaaucccgccuaacggauauuucagauuugauuccugggugaaccaauucuacacccuugcccccauggguaauggcacagggaggcggcgauga

SEQ ID NO: 20711 - RNA, 1617 nt, Artificial Sequence
  derived and/or modified sequence opt3 from VP1__Norovirus_and/or_Norovirus-like__KM198587
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaaggaagacggcagcacccgcgggcacaaggcuacgguguacaccggaucugcccccuuuacaccuaaauuggguuccguccaguucucaacugacaccgagaaugauuuugaaacacaucaaaacacuaaguucaccccagugggcgucauccaggacgggggaacaacccaccgaaaugagccccagcaaugggugcucccgagcuacaguggcagagauguucacaacgugcaucuggccccugcaguagcuccaacuuuucccggugagcaguuacuguucuuuaggucuacgaugccuggguguuccggcuaucccaauauggaccucgauugccuucugccacaggaauggguccagcacuucuaccaagaggcggccccugcacagagcgacguggcuuugcuacgguuuguuaaccccgauacaggacgugugcuguucgaauguaaacuccauaagucgggcuaugucaccguggcccacacugggcagcacgaccugguaauuccaccgaauggauacuuucgcuucgauucuugggugaaccaguucuauacccuugcaccuauggguaacggcacagggagaaggcgguga

SEQ ID NO: 20712 - RNA, 1617 nt, Artificial Sequence
  derived and/or modified sequence opt3 from VP1__Norovirus_and/or_Norovirus-like__KM198560
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucauugugcagccucagaauggcagauguacuaccgacgggguuuugcugggaacaacucaacuauccccagugaacaucugcaccuuuaggggcgaugucacacauauugcagguucacggaauuacaccaugaaccucgcuagucugaauuggaacaauuaugacccgacggaagagauccccgccccucuugggacuccagauuucgugggaaagauccagggcguacugacacagaccacuaagggcgacgggagcacacgcggacacaaggcuaccguuuacacggguucugcccccuuuaccccuaaauugggcuccgugcaguucucaacagacacugaaaacgauuuugaggcacaucaaaauaccaaguucacaccagucggggugauucaggacggaggcacuacccaccgaaacgaaccccagcaauggguccucccgagcuacagugguagagaugugcacaauguucaucuggccccugcuguggcgccaacauuucccggggagcaguuacuguucuuuaggucuaccaugccuggcuguuccggauaucccaacauggaccucgauugccuucugccacaggaguggguacagcacuucuaccaagaagcagccccugcucagagcgacgucgccuugcuacgguuugugaaucccgauacuggccguguucuguucgaguguaaacuccauaagucgggguaugugacggucgcacacacaggacagcacgaccuggugauaccaccgaacgguuacuuucgcuucgauucuuggguaaaccaguucuauacccuugccccuaugggcaaugggacuggaagaaggcgguga

SEQ ID NO: 20713 - RNA, 1617 nt, Artificial Sequence
  derived and/or modified sequence opt3 from VP1__Norovirus_and/or_Norovirus-like__KM198521
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcgcauuuaggggcgaugugacacauaucgcugguucacggaacuacaccaugaaucucgccagucugaacuggaauaacuaugacccgacggaagagauucccgcuccucuugggacuccagauuucguaggaaagauccagggcguucugacacagaccacuaagggcgacgggagcacacgcggacacaaggccaccguguacacggguucugcacccuuuaccccuaaauugggcuccguccaguucucaacagacacugaaaaugauuuugagacccaucaaaacacaaaguucacuccagugggggucauccaggacggaggcaccacacaccgaaaugaaccccagcaaugggugcucccgagcuacagugguagagauguucacaacgugcaucuggccccugcuguagcgccaaccuuucccggggagcaguuacuguucuuuaggucuacuaugccuggcuguuccggauaucccaauauggaccucgauugccuucugccacaggaguggguccagcacuucuaccaagaagcagccccugcucagagcgacguggccuugcuacgguuuguuaaccccgauacgggccgugugcuguucgaguguaaacuccauaagucgggguaugucacaguggcacacaccggacagcacgaccugguaauuccaccgaaugguuacuuucgcuucgauucuugggugaaccaguucuauacucuugccccuaugggcaacgggaccggaagaaggcgguga

SEQ ID NO: 20714 - RNA, 1617 nt, Artificial Sequence
  derived and/or modified sequence opt3 from VP1__Norovirus_and/or_Norovirus-like__KM198490
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgauaucacccauauugcagguucacgggacuacacgaugaaccucgcuagucugaauuggaacaauuaugauccgacugaagagauccccgccccucuugggacaccagacuucgugggaaagauccagggcguacugacccagacuacaaagcgcgacggcagcacccgagggcacaaggcuacgguuuacaccggaucugcccccuuuacaccuaaauuggguuccgugagauucucaacugauaccgaaaacgacuuugagacacaucagaauacuaaguucaccccagucggcgugauucaagaugggagcacaacccacaggaacgaaccccagcaguggguccucccgaguuacucuggacgggacgugcacaauguucaucuggccccugcaguggcuccaacuuuucccggcgagcaauuacuguucuuucguuccacgaugccugguuguagcggguaucccaacauggaucucgacugccuucugccacaggaguggguacagcacuucuaccaggaagcggccccugcacaaucggaugucgcuuugcuacgcuuugugaaucccgacacaggcagaguucuguucgaguguaaacuccauaagucuggauaugugaccgucgcccacacuggccagcacgaucuggugauaccaccgaacggguacuuuagguucgacuccuggguaaaucaguucuauacccuugcaccuaugggaaacgguacaggccggcgacgcuga

SEQ ID NO: 20715 - RNA, 1617 nt, Artificial Sequence
  derived and/or modified sequence opt3 from VP1__Norovirus_and/or_Norovirus-like__KC409241
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauucccggcucucggaauuacaccaugaaccucgccucccagaauuggaacucauaugauccuacggaggaaaucccagcaccccuggguacuccugacuucguugggaagauucagggagugcuuacacagaccacucgcacagacggcagcacccgaggccacaaggcuacggucuacaccgggagugccgauuuuucuccaaagcugggaagagugcaauucgcuacagacacugauaaugacuuugagaccaaccagaauacaaaauucacucccgucggugugauccaggauggcuccaccacacauaggaacgaaccgcaacaguggguuuugccuagcuacucggggcgggacgugcacaauguacaccucgccccagcagucgcccccaccuuuccuggagagcagcuguuauucuuucguucuacuaugcccggcuguuccgguuauccaaacauggaucuggacugccuccuuccucaggaaugggugcaauacuucuaucaggaggcugcgcccgcacagucagauguugcccuguugcgcuuugugaauccagacacggggagaguccuauucgaguguaagcugcauaaaaguggcuacgugacaguagcucacaccggacagcaugaucucgugaucccgccuaacggcuauuuuagguucgacagcuggguuaaucaauucuacacucuggcccccauggggaacggaaccggucggcgacgcuga

SEQ ID NO: 20716 - RNA, 1617 nt, Artificial Sequence
  derived and/or modified sequence opt3 from VP1__Norovirus_and/or_Norovirus-like__JX459625
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguacccggaauuacacgaugaaccucgcuucacugaauuggaacaauuaugacccgacugaagagauucccgccccucuugggacaccagauuucguaggaaagauccagggcguucugacccagacuacaaagggcgacgggaguacccgcggacacaaggcuacgguguacaccgguagcgcccccuuuacaccuaaauugggcucuguccaguucuccacugacaccgaaaacgauuuugagacacaucaaaauacuaaguucaccccagugggggucauccaggacggaggcacaacccaccgaaacgaaccccagcaaugggugcucccgucauacagcgguagaaauguucacaacgugcaucuggccccugcaguagcuccaacuuuucccggggagcaguuacuguucuuuaggaguacgaugccuggcuguucuggauaucccaauauggaucucgacugccuucugccacaggaguggguccagcacuucuaccaagaagcggccccugcacaguccgauguggcuuugaugcgguuuguuaaccccgacacaggccgugugcuauucgaguguaaacugcauaagagcggguaugucaccguggcccacacuggacagcacgaucucguaauuccaccgaacgguuacuuucgcuucgacucgugggugaaucaguucuauacccuggcaccuaugggcaacgggacaggaagaaggcgguga

SEQ ID NO: 20717 - RNA, 1617 nt, Artificial Sequence
  derived and/or modified sequence opt3 from VP1__Norovirus_and/or_Norovirus-like__JX459613
augaagauggccagcaacgacgcucaccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuucaccaaggaaugcccccggggagauccuuuggagugcuccucugggaccagauuugaaccccuacuuaagccaucuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucacaucauaguugacgugcgccaacuggagccaguccuuaucccccugccugaugugcgaaacaauuuuuaucauuacaaccagucgaaugacucaaccauuaaguugaucgcuaugcucuauacaccacugcgugccaacaacgcgggggaagauguguucacugucagcugcagaguucugaccaggcccaguccggacuuugauuucauuuuucucgugccucccacaguagagucccggaccaaaccauucacugugccuaucuuaacagucgaagagaugaccaauucucgcuuucccauaccacuggagaaacuuuucacgggacccagcggugccuucgugguucagccucagaacggcagauguacuaccgacgggguguugcugggaacaacucaacuauccccagucaauauuugcaccuuuaggggcgaugugacacacaucgcagguucacggaacuacaccaugaaucucgcuagucugaacuggaauaacuaugacccgacggaagagauucccgccccucuugggacuccagauuucguaggaaagauccagggcguucugacacagaccacuaagggcgacgggagcacacgcggacauaaggcuaccguguacacggguucugcccccuuuaccccuaaauugggcuccguccaguucucaacagacacugaaaaugauuuugagacccaccaaaacacaaaguucacuccagugggggucauccaggacggaggcaccacacaccgaaaugaaccccagcaaugggugcucccgagcuacagugguagaaacguucauaaugugcaccuggccccugcaguagcuccaaccuuucccggggagcaguuacuguucuuuaggucuacuaugccuggcuguuccggauaucccaacauggaucucgacugccuucugccacaggaguggguccagcauuucuaccaagaagcggccccugcacagagcgauguggcuuugcuacgguuuguuaaucccgacacgggccgugugcuguucgaguguaaacuccacaagucgggguaugucacaguggcccacaccggacagcaugaucugguaauuccaccgaacgguuacuuucgcuucgacucuugggugaaccaguucuauacucuugcaccuaugggcaaugggaccggaagaaggcgguga

SEQ ID NO: 20718 - RNA, 1617 nt, Artificial Sequence
  derived and/or modified sequence opt3 from VP1__Norovirus_and/or_Norovirus-like__JX459600
augaagauggccagcaacgacgcuaaucccuccgauggcucugcagcccaccuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuucaccaaggaaugcccccggggagauccuuuggagugcuccucugggaccagauuugaaccccuacuuaagccaucuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucacaucauaguugacgugcgccaacuggagccaguccuuaucccccugccugaugugcgaaacaauuuuuaucauuacaaccagucgaaugacucaaccauuaaguugaucgcuaugcucuauacaccacugcgugccaacaacgcgggggaagauguguucacugucagcugcagaguucugaccaggcccaguccggacuuugauuucauuuuucucgugccucccacaguagagucccggaccaaaccauucacugugccuaucuuaacagucgaagagaugaccaauucucgcuuucccauaccacuggagaaacuuuucacgggacccagcggugccuucgugguucagccucagaacggcagauguacuaccgacgggguguugcugggaacaacucaacuauccccagucaauauuugcaccuuuaggggcgaugugacacacaucgcagguucacggaacuacaccaugaaucucgcuagucugaacuggaauaacuaugacccgacggaagagauucccgccccucuugggacuccagauuucguaggaaagauccagggcguucugacacagaccacuaagggcgacgggagcacacgcggacauaaggcuaccguguacacggguucugcccccuuuaccccuaaauugggcuccguccaguucucaacagacacugaaaaugauuuugagacccaccaaaacacaaaguucacuccagugggggucauccaggacggaagcaccacacaccgaaaugaaccccagcaaugggugcucccgaguuacucuggcagaaacguucauaaugugcaccuggccccugcaguagcuccaaccuuucccggugagcaguuacuguucuuuagguccacuaugccuggguguagcggcuaucccaacauggaucucgacugccuucugccacaggaguggguccagcauuucuaccaagaagcggccccugcacagucggauguggcuuugcuacgguuuguuaaucccgacacgggacgugugcuguucgaguguaaacuccacaagucuggcuaugucacaguggcccacaccgggcagcaugaucugguaauuccaccgaacggauacuuucgcuucgacuccugggugaaccaguucuauacucuugcaccuauggguaauggcaccgggagaaggcgguga

SEQ ID NO: 20719 - RNA, 1617 nt, Artificial Sequence
  derived and/or modified sequence opt3 from VP1__Norovirus_and/or_Norovirus-like__JX459596
augaagauggccagcaacgacgcucaccccuccgauggcucuaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuucaccaaggaaugcacccggggagauccuuuggagugccccucugggaccagauuugaaccccuacuuaagccaucuggcucggauguauaauggcuacgccgguggguucgaagugcagacuauucuagcgggaaacgcauuuacggccggcaaaaucauuuucgcugccgucccuccaaauuuuccgaccgagggccucucccccucucaggugacaauguucccucacaucauaguagacguucgccaacuggagccagugcuuaucccccugccugauguccgaaacaauuuuuaucauuacaaccagucgaaugacccaacuauuaaguugaucgcaaugcucuauacaccccugcgugcuaacaacgccggggaugacguguucaccgugucaugcagaguccugaccaggccgagcccugauuuugacuucauuuuucucguucccccaacuguggaaagucggacaaaaccuuucaccguacccaucuuaacgguggaggaaaugacuaauucccgcuuuccaauaccccuggagaaacuuuucaccggaccuucuagcgcguucgucgugcagccacagaacgguagauguacaacugauggcguuuugcuggggaccacacaacuauccccggugaauauuugcaccuuuaggggagacgucacgcacaucgccggcacucauaacuacacaaugaaucucgcaucacagaacuggaauaacuaugaucccaccgaggaaauuccugcuccacuggguacucccgacuucguggggcggauccagggaaugcuuacacagaccacgcgcggcgacggcaguacccgagggcacaaggccacaguaagcacuggagauguucacuuuaccccuaagcuggguucuauccaauucaauacagacacuaacaaugauuuugagaccggccagaacacaaaguucaccccagugggggucgugcaggacggaaauggcacucaucaaaacgaaccccagcagugggucuugccguccuacucagguagaacggggcacaaugugcaucucgcuccugccguugcaccaacauuucccggcgagcagcuguuauucuuuaggagcaccaugccuggauguaguggcuaccccaacaugaaccuggauugccuccuuccacaagaaugggugcagcacuucuaucaggaggccgcuccugcgcagucugacguagcacuguugcgguuugucaaucccgauacugggcgugugcuauucgaguguaaacugcacaaguccggauacguuaccguggcccauacaggucaacacgaccucgucauuccaccgaacggcuauuuucgcuucgauagcugggugaaucaguucuacacccuggcuccuauggggaacggaacuggcagaaggcgguga

SEQ ID NO: 20720 - RNA, 1617 nt, Artificial Sequence
  derived and/or modified sequence opt3 from VP1__Norovirus_and/or_Norovirus-like__JX155749
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagccgggcuaugucacaguggcccauaccgggcagcacgaucugguaauuccucccaacggauacuuucgcuucgacucuugggugaaucaguucuauacucuugcaccaauggguaacggcaccgggagaaggcgguga

SEQ ID NO: 20721 - RNA, 1617 nt, Artificial Sequence
  derived and/or modified sequence opt3 from VP1__Norovirus_and/or_Norovirus-like__JQ613511
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcagugacccaacaauuaaguugaucgcaaugcucuauacuccccugcgugcuaauaacgccggcgaugacguguucaccgucuccugcagaguucugacaaggccgucuccugauuuugacuucauuuuucucgugcccccaaccguagaaagccggacuaaaccuuucuccgugcccaucuuaacagucgaggaaaugaccaacucacgcuuuccaauaccccuggagaaacuuuucacggggccuaguagcgcguucgugguucagccacagaauggaagauguacuaccgaugguguguugcugggcacaacucaacuaucuccggucaacauuugcaccuuuaggggagacgugacacauaucgccgggacccaggaguacacgaugaaucucgcaucccagaacuggaauaacuaugaucccacugaagagauuccugcuccacugggcacacccgacuucguagguaagauccaggggguucuuacccaaacuacacggcgcgacggaucaacccgaggccacaaggccacggugagcaccggcaguguccauuuuacaccuaagcuggggagaauccaguucucuacugauaccuccaaugacuuugaaacaggacagaacacuagguucaccccagugggugucgugcaagauggcagcacaacccaccagaaugagccccagcaguggguuuugccgaacuacucggggcgggacucucacaaugugcaucucgcuccugccguagcaccauccuuucccggagaacaacuguuauucuuucguucaacuaugccuggcuguagugguuaccccaacauggaucuggacugccuccuuccacaggaguggguccagcacuucuaucaggaggccgcuccugcgcaaagcgauguggcacuguugcgcuuuguuaaucccgacacggggagagugcuauucgaauguaaacugcauaaguccggcuacgucacaguggcccacaccggacagcacgaucucguaauuccaccgaacggcuauuuuagguucgacucuugggugaaucaguucuacacucuggcuccuauggggaacggaaccggucggcgacgcuga

SEQ ID NO: 20722 - RNA, 1617 nt, Artificial Sequence
  derived and/or modified sequence opt3 from VP1__Norovirus_and/or_Norovirus-like__HM802547
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagagcaacgacaguaccauuaaguugaucgcuaugcucuauacaccacugcgugccaauaacgcgggggaugacguguucacugucuccugcagaguucugaccaggcccucuccggauuuugacuucauuuuucucgugccucccacaguagaaagccggaccaaaccauucacugugccuaucuuaacagucgaggaaaugaccaacucccgcuuucccauaccacuggagaaacuuuucacgggacccucaagugccuucgugguucagccucagaaugguagauguacuaccgauggcguguugcuggggacaacucaacuaagcccagucaacauuugcaccuuuaggggagacgugacacauaucucuggcucccggaauuaccgcaugaaccucgcaucacagaauuggaacaauuaugauccgaccgaggaaauucccgcuccucuggguacgccagacuucguagggaagauccagggaaugcuuacucagacaaccaagggcgacggcagcacucgagggcacaaggccacaguuaguaccggaucuguggauuuuacgcccaaacuggguuccguccaauucgcuaccgacacagauaacgacuuugagacuggccagaauaccagauucacaccugugggggucauccaggauggaagcucggcccauaggaacgaaccacaacaguggguguugcccgacuacucuggccggacuguucacaaugugcaccucgcaccggccguagcuccuaccuuuccaggugagcagcuguuauucuuucguuccacaaugcccggguguucaggcuacccuaacauggaucuggacugccuccuuccccaggaauggguccaacauuucuaucaggaggcggcaccaagucagagcgauguggcccuguugcgcuuuguuaauccugacaccggaagagugcuauucgaguguaagcugcacaaagcuggcuacgucacuguggcccauacggggcagcacgaucucguaauucccccaaacggauauuuuagguucgacuccugggugaaucaauucuacacacuggcaccgauggguaacggcgccgggcggcgacgcuga

SEQ ID NO: 20723 - RNA, 1617 nt, Artificial Sequence
  derived and/or modified sequence opt3 from VP1__Norovirus_and/or_Norovirus-like__HM802544
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacucaacuauuaaguugaucgcaaugcucuauaccccacugcgugcuaacaacgccggggaugacguguucacagucagcugcagaguucugaccaggcccaguccggauuuugacuucauuuuucucgugccucccacuguagaaucccggacaaaaccauucucugugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucgccggcacgcagaacuacacuaugaaucucgcaagccagaacuggaauaacuaugauccgacagaggaaauucccgcuccucuggguaccccagacuucguagggaagauccagggaguucuuacucaaacaacccggcgcgacggcucuacgcgaggccacaaggccaccguguccacagggucaguccauuuuacucccaagcugggaagcgugcaguucaguaccgauacaucuaaugacuuugagacuggucagaacaccagauucacaccugucggcgugguucaagauggguccaccacucaccagaaugaaccacagcaguggguguugcccgacuacagcggaagggauucgcacaacguacaucucgcuccggccgucgcaccuacguuuccaggcgagcaacuguuauucuuucggucuacaaugcccgguuguuccggguacccuaauaugaaccuggacugccuccuuccccaggaaugggugcagcacuucuaucaggagucagccccagcucaaagugauguugcgcuguugcguuuugugaauccugacaccggccgcguccuauucgaguguaaacugcauaagagcggauacgugacuguagcacacaccggccagcacgaucucgugauucccccaaacggguauuuuagauucgacuccuggguuaaccaguucuacacacuggccccgaugggaaauggugcuggcaggcggcgauga

SEQ ID NO: 20724 - RNA, 1617 nt, Artificial Sequence
  derived and/or modified sequence opt3 from VP1__Norovirus_and/or_Norovirus-like__GQ856456
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguuggggugcgccaacuggagccaguccuuaucccccugccugacgugcgaaauaacuuuuaucacuacaaucagucgaacgauucaaccauuaaguugaucgcuaugcucuauacaccacugcgugccaacaaugcgggagaagacguguucacugucagcugcagaguucugaccaggcccaguccggauuuugacuucauuuuucucgugccucccacaguagagucccggaccaaaccauucacugugccuaucuuaacagucgaagagaugaccaacucucgcuuucccauaccacuggagaaacuuuucacgggucccagcuccgccuucgugguucagccucagaauggcagauguacuaccgaugggguguugcugggaacaacucaacuaucaccagucaacauuugcaccuuuaagggcgacgugacacauaucgcagguaguaggaauuacaccaugaaccucgcuagccugaauuggaacaauuaugauccgacggaagagauucccgccccucuugggacuccagacuucguaggaaagauccagggcguucugacacagaccacuaagggcgaugggucuacacggggacacaaagcuaccguguacacggguuccgcccccuuuaccccuaaguugggcucaguccaguucagcacagacacugaaaacgacuuugagacccaucaaaauacaaaauucacuccagugggggucauccaggauggaggcaccacacaccgcaacgaaccccagcaaugggugcucccgaguuacucuggucgaaauguucagaacgugcaccuggccccugcaguagcuccaaccuuucccggggagcaguuacuguucuuuagauccacuaugccuggcuguagcggauaucccaauauggaccucgauugccuucugccacaggaguggguccaacauuucuaccaggaagcggccccugcacagucggacguggcuuugcuaagguuuguuaaccccgauacgggccgggugcuguucgaguguaagcuccacaaaucuggguaugucacaguggcccauaccggacagcacgaccugguaauuccaccgaacgguuacuuucguuucgauuccugggugaaucaauucuauacucuugcaccuaugggcaacgggaccggacgcagaagguga

SEQ ID NO: 20725 - RNA, 1617 nt, Artificial Sequence
  derived and/or modified sequence opt3 from VP1__Norovirus_and/or_Norovirus-like__AB541332
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguggcgcccccuuuacaccuaaauuggggucugcacaguucuccacugacaccgaaaacgauuuugagacacaucagaauacuaaguucaccccagucggagugauccaagacggcgguacaacccaccgaaacgaaccccagcaguggguccucccgucauacagcgggagaaaugugcacaacguucaucuggccccugcuguggcgccaacuuuucccggcgagcaauuacuguucuuuaggaguacgaugccuggauguucuggcuaucccaauauggaucucgacugccuucugccacaggaguggguacagcacuucuaccaggaagcagccccugcucaauccgaugucgccuugcuacgguuugugaaccccgacacagggcguguucuguucgaguguaaacuccauaagagcggauaugugaccgucgcacacacuggucagcacgaucuggugauuccaccgaacggcuacuuucgcuucgacucguggguaaaucaguucuauacccuugccccuauggggaacggaacaggcagaaggcgguga

SEQ ID NO: 20726 - RNA, 1617 nt, Artificial Sequence
  derived and/or modified sequence opt3 from VP1__Norovirus_and/or_Norovirus-like__AB541316
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccauggaccucgcuagccugaacuggaauaacuaugauccgacggaagagauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugaaaaugacuuugagacccaucaaaacacaaaguucacuccagugggcgucauccaggaugggggaaccacacaccgaaaugaaccccagcaaugggugcucccgaguuacucuggcagaaacguuccuaaugugcaccuggcaccagccguagcucccaccuuuccuggugagcaguuacuguucuuuagguccacuaugcccggguguagcggcuauccaaacauggaccucgauugccuucugccucaggaguggguccagcauuucuaccaagaagcggcacccgcccagucggacguggcuuugcuacgguuuguuaauccagauacgggacgugugcuguucgaguguaaacuccacaagucuggcuaugucacaguggcccauaccgggcagcacgaccugguaauuccgccuaacggauacuuucgcuucgauuccugggugaaccaguucuauacucuugcacccauggguaauggcaccgggagaaggcgguga

SEQ ID NO: 20727 - RNA, 1617 nt, Artificial Sequence
  derived and/or modified sequence opt3 from VP1__Norovirus_and/or_Norovirus-like__AB541238
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaggcaccacacaccgaaacgaaccccagcaaugggugcucccgagcuacagugguagagauguucacaaugugcaucuggccccugcaguagcuccaaccuuucccggggagcaguuacuguucuuuaggucuacuaugccuggcuguuccggauaucccaacauggaccucgauugccuucugccacaggaguggguccagcacuucuaccaagaagcggccccugcacagagcgacguggcuuugcuacgguuuguuaaucccgauacgggccgugugcuguucgaguguaaacuccauaagucgggguaugucacaguggcccacaccggacagcacgaccugguaauuccaccgaacgguuacuuucgcuucgauucuugggugaaccaguucuauacucuugcaccuaugggcaaugggaccggaagaaggcgguga

SEQ ID NO: 20728 - RNA, 1617 nt, Artificial Sequence
  derived and/or modified sequence opt3 from VP1__Norovirus_and/or_Norovirus-like__AB535750
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucgggcccucccagguaacgauguucccucauaucauaguugacgugcgccaacuggagccaguccuuaucccccugccugaugugcgaaauaacuuuuaucacuacaaucagucuaacgacucgaccauuaaguugaucgcuaugcucuauacaccacugcgugccaacaaugcgggagaagauguguucacugucucaugcagaguucugaccaggcccagcccggacuuugauuucauuuuucucgugccucccacaguagagagucggaccaaaccauucacugugccuaucuuaacagucgaagagaugaccaacucccgcuuucccauaccacuggagaaacuuuucacgggucccucuagcgccuucgugguucagccucagaauggcagauguacuaccgacgggguguugcugggaacaacucaacuauccccagucaacauuugcaccuuuaggggcgaugugacacggaucgcagguucacgcaauuacaccaugaaccucgcuagucugaauuggaacaauuaugacccgacggaagagauucccgccccucuugggacuccagauuucguaggaaagauccagggcguucugacacagaccacuaagggcgacgggagcacacgaggacauaaggcuaccguguacacggguucugcccccuuuaccccuaaauugggcuccguccaguucucaacagacacugaaaacgauuuugagacccaccaaaauacaaaguucacuccagugggggucauccaggacggaggcaccacacauagaaacgaaccccagcaaugggugcucccgagcuacagugguaggaauguuccuaacgugcaccuggcaccagccguagcucccaccuuuccuggggagcaguuacuguucuuucggucuacuaugcccggcuguuccggauauccaaauauggaucucgacugccuucugccucaggaguggguccagcacuucuaccaagaagcggcacccgcccagagcgauguggcuuugcuacguuuuguuaacccagacacgggccgcgugcuguucgaguguaaacuccauaagucgggguaugucacaguggcccacaccggacagcaugaucugguaauuccgccuaacgguuacuuuagauucgacucuugggugaaucaguucuauacucuugcacccaugggcaacgggaccggaaggcggcgauga

SEQ ID NO: 20729 - RNA, 1617 nt, Artificial Sequence
  derived and/or modified sequence opt3 from VP1__Norovirus_and/or_Norovirus-like__FJ538900
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccgcugaagagauuccugccccacuggggacacccgauuucguaggacggauccagggcguucuuacccagacuacacgcggcgacgggucaacccgaggacauaaggcuacggugaguaccggugacguccacuuuacaccuaagcugggcagcauccaauucaacacugauaccaauaacgacuuugaaacagggcagaauacuaaguucaccccagugggagucgugcaggauggcaacgguacacaccaaaaugagccccagcaguggguuuugccgucuuacuccgggagaaccggccauaacgugcaccucgccccugcaguagccccaacuuuucccggagaacagcuguuauucuuuaggucaacgaugccuggcuguagcggguaccccaacaugaaucuggacugccuccuuccacaagaguggguccagcauuucuaucaggaggcugcgccugcacagagugauguggcccuguugcgguuuguuaaccccgacacaggacgugugcuauucgaauguaaacugcacaagucugguuacgucaccguggcucacacuggccaacaugaucucguaauuccaccgaauggguauuuucgcuucgacuccugggugaaccaguucuacacccuggccccuaugggaaauggcacagguagaaggcgguga

SEQ ID NO: 20730 - RNA, 1617 nt, Artificial Sequence
  derived and/or modified sequence opt3 from VP1__Norovirus_and/or_Norovirus-like__EU876889
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguagguaagauccaggggguucuuacccaaacuacacggcgcgacggauccacccgaggccacaaggccacggugucaaccggcagcguccauuuuacaccuaagcuggggagaauccaguucaguacugauaccucuaacgacuuugaaacaggacagaauacuagguucaccccagugggugucgugcaagauggcgggacaacccaccagaacgagccccagcaguggguuuugccgaauuacuccggacgggacagccacaacgugcaucucgcuccugccguagcaccaucguuucccggcgaacaacuguuauucuuucguucuacuaugccugguuguuccggguaccccaauaugaaccuggauugccuccuuccacaggaguggguccagcacuucuaucaggaggccgcuccugcgcaaucagacguggcacuguugcgcuuuguuaaucccgauacgggcagagugcuauucgaauguaaacugcauaagaguggauacgucacaguggcccacaccggccagcacgaccucguaauuccaccgaacggguauuuuagguucgauagcugggugaaccaguucuacacucuggcuccuaugggaaaugguaccggccggcgacgcuga

SEQ ID NO: 20731 - RNA, 1617 nt, Artificial Sequence
  derived and/or modified sequence opt3 from VP1__Norovirus_and/or_Norovirus-like__EU876887
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguagguaagauccaggggguucuuacccaaacuacacggcgcgacggauccacccgaggccacaaggccacggugucaaccggcagcguccauuuuacaccuaagcuggggagaauccaguucaguacugauaccucuaacgacuuugaaacaggacagaauacuagguucaccccagugggugucgugcaagauggcuccacaacccaccagaacgagccccagcaguggguuuugccgagcuacucggggcgggacucucacaaugugcaucucgcuccugccguagcaccauccuuucccggagaacaacuguuauucuuucguucaacuaugccuggcuguagugguuaccccaacaugaaucuggauugccuccuuccacaggaguggguccagcacuucuaucaggaggccgcuccugcgcaaagcgacguggcacuguugcgcuuuguuaaccccgauacggggagagugcuauucgaauguaaacugcauaaguccggcuacgucacaguggcccacaccggacagcacgaccucguaauuccaccgaauggcuauuuuagguucgauucuugggugaaccaguucuacacucuggcuccuauggggaacggagccggucggcgacgcuga

SEQ ID NO: 20732 - RNA, 1617 nt, Artificial Sequence
  derived and/or modified sequence opt3 from VP1__Norovirus_and/or_Norovirus-like__FJ411171
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaugaucguugacgugcgccaacuggagccaguccuuauaccccugccugaugugcgaaauaacuuuuaucacuacaaucagucgaacgacccaacaaucaaguugauugcaaugcucuauacuccccugcgugcuaacaaugccggggaugacguguucaccgucucaugcagaguucugacaaggccgagcccugauuuugacuucaucuuucucgugcccccaaccguagaaagucggacuaaaccuuucacagugcccauuuuaaccgucgaggaaaugacgaacucccgcuuuccaaucccccuggagagacuuuacacuggaccuucuagcgcguucgugguucagccacagaaugguagguguaccacagauggcguguugcuggggacuacccaacuauccgccgucaacauaugcacauuccggggagacgugacccauauugcaggcucacgcaauuauacgaugaaccucgcuagucagaauuggagcaacuacgauccgacugaggaaauccccgccccucuggguacaccagacuuuguagggaagauucagggaaugcuuacccagacuacacgaagagacggcucuaccaggggccacaaagcuacgguucugaccggguccgccgauuucgcacccaaguugggacgggugcaauuugccacagacacugauaaugacuucgagucaggugaaaacaccaaguuuacaccugucggcgugauccaggaugggagcacuacccaucguaaugagccacagcaauggguccuccccaacuacaguggacgcacaggccacaaugugcaccuggcuccggcgguugcaccuaccuauccaggugaacaguuacuguucuuuagaucuacuaugcccggguguuccggcuacccuaacauggaccucgauugccuucugccccaggagugggugaggcauuucuaucaggaggccgcuccagcccaaagcgacguagcauugcuacgguuugucaauccugauacgggacgagugcuguucgaauguaaacuccacaagucgggcuacguuacaguggcccauaccgggcagcacgaccuggucauucccccaaacggauauuuucgcuucgauucuugggugaaccaguuuuacacucuugcuccgauggguaauggcgccgggagaaggcgguga

SEQ ID NO: 20733 - RNA, 1617 nt, Artificial Sequence
  derived and/or modified sequence opt3 from VP1__Norovirus_and/or_Norovirus-like__AB447460
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacagcuaugacccgacggaagagauucccgccccucuugggacuccagauuucguaggaaaaauccagggccuguugacacagaccacuaagggcgacgggucuacacgcggacacaaggcuaccguuuacacggguuccgcccccuuuaccccuaaacucggcucagugcaguucagcacagacacugaaaaugauuuugagacccaucaaaacacaaaguucacuccagucggggugauccaggacggaaguaccacacaccgaaaugaaccccagcaauggguccugccgucuuacuccggcagaaacgugcacaauguucauuuagccccugcaguggcuccaaccuuucccggugagcagcuucucuucuuuaggagcacuaugccuggguguucgggcuaucccaacauggaucuugacugccuguugccacaggaguggguacagcacuucuaccaagaagcggccccugcacagucugaugucgcucuacugcgguuugugaaucccgacacgggacguguucucuucgaguguaaacugcauaaguccggcuaugugacagucgcccacaccgggcagcacgaucuugugauuccaccgaacggauacuuucgcuucgacucauggguaaaccaguucuauacucuggcaccuauggguaauggcaccgggagaaggcgguga

SEQ ID NO: 20734 - RNA, 1617 nt, Artificial Sequence
  derived and/or modified sequence opt3 from VP1__Norovirus_and/or_Norovirus-like__AB447454
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguacccggaauuacacgaugaaccucgcuucacugaauuggaacaauuaugacccgacugaagagauucccgccccucuugggacaccagauuucguaggaaagauccagggcguucugacccagacuacaaagggcgacgggaguacccgcggacacaaggcuacgguguacaccgguagcgcccccuuuacaccuaaauugggcucuguccaguucuccacugacaccgaaaacgauuuugagacacaucaaaauacuaaguucaccccagugggggucauccaggacggaggcacaacccaccgaaacgaaccccagcaaugggugcucccgucauacagcgguagaaauguucacaacgugcaucuggccccugcaguagcuccaacuuuucccggggagcaguuacuguucuuuaggaguacgaugccuggcuguucuggauaucccaauaugaaccucgauugccuucugccacaggaguggguccagcacuucuaccaagaagcggccccugcacaguccgacguggcuuugcuacgguuuguuaaccccgauacaggccgugugcuguucgaguguaaacuccauaagagcggguaugucaccguggcccacacuggacagcacgaccugguaauuccaccgaaugguuacuuucgcuucgauucgugggugaaccaguucuauacccuugcaccuaugggcaaugggacaggaagaaggcgguga

SEQ ID NO: 20735 - RNA, 1617 nt, Artificial Sequence
  derived and/or modified sequence opt3 from VP1__Norovirus_and/or_Norovirus-like__AB447443
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaggaacuucccgccccucuggggacuccagauuucguaggaaaaauucagggcguuuugacacagaccacuaagggcgacgggagcacacgcggacacaaggcuaccguguacacggguucugcccccuuuaccccuaaacucggcuccguccaguucucaacagacacugaaaacgauuuugagacccaucaaaauacaaaguucacuccagugggggucauccaggacggaagcaccacacaccgaaacgaaccccagcaaugggugcugccgaguuacucuggcagaaauguucacaacgugcauuuagccccugcaguagcuccaaccuuucccggugagcagcuucucuucuuuagguccacuaugccuggguguagcggcuaucccaauauggaucuugacugccuguugccacaggaguggguccagcacuucuaccaagaagcggccccugcacagucggauguggcucuacugcgguuuguuaaccccgacacgggacguguccucuucgaguguaaacugcauaagucuggcuaugugacaguggcccacaccgggcagcacgaucuuguaaucccaccgaacggauacuuucgcuucgacuccugggugaaucaguucuauacucuggcaccuauggguaacggcaccgggagaaggcgguga

SEQ ID NO: 20736 - RNA, 1617 nt, Artificial Sequence
  derived and/or modified sequence opt3 from VP1__Norovirus_and/or_Norovirus-like__AB447430
augaagauggccagcaacgacgcuaaucccuccgauggcucuaccgcaaaccuggugccugaggucaauaacgaaguuauggcccucgagccagugguaggggcggcuaucgccgcaccgguggccggacagacaaaugucauugaccccuggauaagaaacaauuucgugcaagcuccugguggcgaauuuacuguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacggccggcaaaaucauuuucgcuaaggugccuccaaacuuuccgaccgagggccucucccccucucagguaacaauguucccucauaucauaguugacgugcgccagcuggagccaguccuuaucccccugccugaugugcgaaauaacuuuuaucacuacaaucaaucgaacgacucaacuauuaaauugaucgccaugcucuauaccccacugcgugcaaacaaugcuggggaagauguguucacagucagcugcagaguucugaccaggcccaguccggacuuugauuucauuuuucucgugccucccacuguagagucccggacaaagccauucaccgugccuaucuuaacggucgaagagaugacuaacucucgcuuucccauaccacuggagaaacuuuucaccggacccagcggugccuucgugguucagccucagaauggcagauguacaacugacgggguguugcugggaaccacacagcuauccccagucaacauuugcaccuuuaggggcgaugugacgcauaucgcggguucacggaauuacacuaugaaccucgccagucugaauuggaacaauuaugacccgacagaagagauucccgcaccucuugggaccccagauuucguaggaaagauccaaggcguucugacucagacaaccaagggcgacgggagcacgcgcggacacaaagcuaccguguacacagguucugcccccuuuacuccuaaguugggcuccguccaguucucaaccgacacagaaaacgauuuugagacucaucagaauaccaaauucacaccagugggggucauccaagacggaagcaccacucaccgaaacgaaccccagcagugggugcucccgaguuacucuggcagaaauguucacaacgugcaucuggcuccugccguagcaccaacguuucccggugagcaauuacuguucuuuagguccacaaugccuggguguagcggcuaucccaauauggaucucgacugccuucugccacaggaguggguccagcacuucuaccaggaagccgcuccugcgcaaucggauguggcauugcuacgguuuguuaaccccgacaccggacgugugcuguucgaguguaagcuccauaaaucuggcuaugucacuguggcccacaccgggcagcacgaucugguaauuccaccgaacggauacuuucgcuucgacuccugggugaaucaguucuauacacuugcuccuauggguaacggcaccgggagaaggcgguga

SEQ ID NO: 20737 - RNA, 1617 nt, Artificial Sequence
  derived and/or modified sequence opt3 from VP1__Norovirus_and/or_Norovirus-like__EU078420
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguucacaacgugcaucuggccccugcaguagcuccaaccuuucccggcgagcaguuacuguucuuuaggagcacuaugccugguuguucgggguaucccaauauggaucucgacugccuucugccacaggaguggguccagcacuuccaucaagaagcggccccugcacagucugauguggcuuugcuacgguuuguuaaccccgacacgggccgugugcuguucgaguguaaacuccacaaguccggauacgucacaguggcccacaccggccagcaugaucugguaauuccaccgaacggguauuuucgcuucgacucaugggugaaucaguucuacacucuugcaccuaugggaaacgguaccggcagaaggcgguga

SEQ ID NO: 20738 - RNA, 1617 nt, Artificial Sequence
  derived and/or modified sequence opt3 from VP1__Norovirus_and/or_Norovirus-like__AB385637
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguagguaagauccaggggguucuuacccaaacuacacggcgcgacggauccacccgaggccacaaggccacggugucaaccggcagcguccauuuuacaccuaagcuggggagaauccaguucaguacugauaccucuaacgacuuugaaacaggacagaauacuagguucaccccagugggugucgugcaagauggcuccacaacccaccagaacgagccccagcaguggguuuugccgaauuacagcgggcgggacggacacaacgugcaucucgcuccugccguagcaccaucguuucccggcgaacaacuguuauucuuucguucuacuaugccugguuguuccggguaccccaauaugaaccuggauugccuccuuccacaggaguggguccagcacuucuaucaggaggccgcuccugcgcaaucagacguggcacuguugcgcuuuguuaaucccgauacgggcagagugcuauucgaauguaaacugcauaagaguggauacgucacaguggcccacaccggccagcacgaccucguaauuccaccgaacggguauuuuagguucgauagcugggugaaccaguucuacacucuggcuccuaugggaaaugguaccggccggcgacgcuga

SEQ ID NO: 20739 - RNA, 1617 nt, Artificial Sequence
  derived and/or modified sequence opt3 from VP1__Norovirus_and/or_Norovirus-like__EF202568
augaagauggccagcaacgacgcuacccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagucgaaugacccaacaauuaaguugaucgcuaugcucuauacuccccugcgugccaacaacgcgggggaugacguguucaccgucucaugcagaguucugacaaggccgagcccugauuuugacuucauuuuucucgugcccccaaccguagaaagucggacuaaaccuuucuccgugcccaucuuaacagucgaggaaaugaccaauucucgcuuuccaauaccccuggagaaacuuuucacgggaccuagcuccucauucgugguucagccacagaacgguagauguacuaccgauggcguguugcuggggacaacucaacuaaguccggucaauauuugcaccuuuaggggagacgugacacauaucgccggcacccagaacuacacgaugaaucucgcaagccagaacuggaauaacuaugaucccacugaggaaauuccugcuccacuggguacacccgacuucguagggaagauccagggaguucuuacccaaacuacacggcgcgacggcucuacccgaggccacaaggccacgguguccaccgggucaguccauuuuacaccuaagcugggaagcgugcaguucaguacugauaccucuaaugacuuugagacaggucagaacacuagauucaccccagucggcgugguucaagauggguccacaacuccccagaaugaaccgcagcaguggguguugccugacuacagcggaagggauucgcacaacguacaccucgcuccagccgucgcacccaccuuuccuggcgagcaacuguuauucuuucggucuacgaugcccgguuguuccggguacccaaauaugaaccuggacugccuccuuccucaggaaugggugcagcauuucuaucaggagucagcccccgcucaaagugauguugcgcuguugcguuuugugaauccagacacaggccgcguccuauucgaguguaaacugcacaagagcggauacgugaccguagcacauacuggccagcacgaucucgugaucccgccuaacggguauuuuagauucgacuccuggguuaaccaguucuacacccuggcccccaugggaaauggugcuggcaggcggcgauga

SEQ ID NO: 20740 - RNA, 1617 nt, Artificial Sequence
  derived and/or modified sequence opt3 from VP1__Norovirus_and/or_Norovirus-like__AB294781
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccgucuuaaccguggaagagaugacgaacucccgcuuuccaaucccccuggagaaacuuuucacuggaccuucuggugcguucguugugcagccacagaauggcagauguaccacagacggggucuugcugggaacuacccaacuaagcccggugaacauaugcacauuuaggggcgauguaacccauauugccgguacgcacaauuacacuaugaaccucgcaucccagaauuggaacaauuaugaccccacagaagagaucccugcuccacuggggacccccgauuucguuggacggauucagggcaugcuuacucagacaaccaagggcgacgggucaacgcgcggacauaaggccaccgugaguacaggugacguccacuuuacuccuaagcugggcagcauccaauucaacaccgauacaaauaacgacuuugaaacugggcagaauaccaaauucacaccagugggagucgugcaggauggcaacgguacccaccaaaaugagccccagcaguggguuuugccgucuuacuccgggcgaacuggccauaacgugcaccucgcuccugccguagcaccaacguuucccggagaacagcuguuauucuuuagaucaacaaugccuggcuguagcggguaccccaacaugaaucuggacugccuccuuccacaagaguggguccagcauuucuaucaggaggccgcuccugcgcagagugauguggcacuguugagguuuguuaaccccgacaccggacgggugcuauucgaauguaagcugcacaaaucugguuacgucacuguggcccacaccggccaacaugaucucguaaucccaccgaauggguauuuucguuucgacuccugggugaaccaguucuacacacuggcuccuaugggaaauggcaccggucgcagaagguga

SEQ ID NO: 20741 - RNA, 1617 nt, Artificial Sequence
  derived and/or modified sequence opt3 from VP1__Norovirus_and/or_Norovirus-like__AB303940
augaagauggccagcaacgacgcuacccccuccgauggcucuacagcaaaucuggugccugaggucaacacugaaguuauggcccucgagccagugguaggggcggcuaucgccgcaccgguggccggacagcaaaaugucauugaccccuggauaagaaacaauuucgugcaggcuccugguggcgaauuuacgguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuaccgccggcaaaaucauuuucgcugccgugccuccaaacuuuccgacagagggccucucccccucucagguaacuauguucccucauaucauaguugacgugcgccaacuggagccaguccuuaucccccugccugaugugcgaaauaacuuuuaucacuacaaucagucgaacgacccaaccauuaaguugaucgcaaugcucuauacaccccugcguaccaauaacgcuggggaugacguguucacugucucaugcagaguucugacaaggccgagcccugauuuugacuucauuuuucucgugcccccaaccguagaaagucggacgaaaccuuucuccgugcccaucuuaacugucgaggaaaugaccaacucucgcuuuccaauaccccuggagaaacuuuucacaggaccuagcuccgccuucgugguucagccacagaaugguagauguacuaccgauggcguguugcuggggacaacccaacuaucaccggucaacauuugcacguuuaggggagacgugacucauaucgcgggcacacagaauuacaccaugaaccucgccagucagaauuggaacaauuaugaucccacugaggaaauuccugcaccacuggguacacccgacuucguagggaagauccagggaguucuuacccaaacgacccggcgcgacggcagcacacgaggccacaaggcuacugugucuaccggguccauccauuuuacaccuaagcugggaucaguccaguucagcacugauaccaguaacgacuuugagacaggucagaauaccagauucacuccagugggcgucgugcaagaugggucuacgacacaccagaacgaaccccagcaguggguuuugccggacuacuccggaagggauagccacaaugugcaucucgccccugcuguagccccaaccuuucccggcgagcaacuguuauucuuucggucgacuaugccugguuguucuggguaccccaacaugaaucuggacugccuccuuccacaggaauggguccagcacuucuaucaggaguccgccccugcacaaucagauguggcucuguugcguuuuguuaaccccgacaccggccgcgugcuauucgaguguaaacugcauaagaguggauacgucacaguggcgcacaccggccagcacgaucucguaauuccaccgaauggguauuuuagauucgacagcugggugaaccaguucuacacucuggcaccuaugggaaacggugccggcaggcggcgauga

SEQ ID NO: 20742 - RNA, 1617 nt, Artificial Sequence
  derived and/or modified sequence opt3 from VP1__Norovirus_and/or_Norovirus-like__DQ415279
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauguuaucguggacguccgccaacuggagccagugcuuauaccccugccugaugugcgaaauaacuuuuaucacuacaaucagucgaacgacccaacaaucaaguugauugcaaugcucuauacuccccugcgugcuaacaaugccggggaagaugucuucaccguuucaugcagagugcugacaaggccgagcccugacuuugauuucaucuuucucguacccccaaccguggagagucggacuaaaccuuucacaguccccauuuuaaccguggaagagaugacgaacucccgcuuuccaaucccccuggagaaacuuuucacuggaccuucuggugcguucguugugcagccacagaauggcagauguaccacagacggggucuugcugggaacuacccaacuaagcccggugaacauaugcacauuuaggggcgauguaacccauauugccgguacgcacaauuacacuaugaaccucgcaucccagaauuggaacaauuaugaccccacagaagagaucccugcuccacuggggacccccgauuucguuggacggauucagggcaugcuuacucagacaacccgcggcgacgggucaacgcgaggacauaaggccaccgugaguacaggugacguccacuuuacuccuaagcugggcagcauccaauucaacaccgauacaaauaacgacuuugaaacugggcagaauaccaaguucacaccagugggagucgugcaggauggcaacgguacccaccaaaaugagccccagcaguggguuuugccgucuuacuccgggagaacuggccauaacgugcaccucgcuccugccguagcaccaacguuucccggagaacagcuguuauucuuuaggucaacaaugccuggcuguagcggguaccccaacaugaaucuggacugccuccuuccacaagaguggguccagcauuucuaucaggaggccgcuccugcgcagagugauguggcacuguugcgguuuguuaaccccgacaccggacgugugcuauucgaauguaaacugcacaagucugguuacgucacuguggcccacaccggccaacaugaucucguaaucccaccgaauggguauuuucgcuucgacuccugggugaaccaguucuacacacuggcuccuaugggaaauggcaccgguagaaggcgguga

SEQ ID NO: 20743 - RNA, 1617 nt, Artificial Sequence
  derived and/or modified sequence opt3 from VP1__Norovirus_and/or_Norovirus-like__DQ078794
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagguacucucccccucucagguuacaauguucccucauaucauaguggacguccgccaacuggagccagugcuuaucccccugccugaugugcgaaacaauuuguaucacuacaaccagucgaaugacccaacuauucgucucaucgcaaugcuguauacgccccugagagcuaacaacgccggcgaugacgucuuuacaguuucaugcagggugcucacccggccgagcccugauuucgacuuuauguucuuaguacccccaacuguggaaagucgcacaaagccuuuuuccguccccauucugaccguggaggaaaugaccaauucuagauucccaaucccccuugagaaauuguuuacugggccuagcuccgcguucguugugcagccacagaacggaagguguaccacagaugguguccugcuaggcacuacccaacucucaccggugaauauaugcacauuccgcggggacguaacccauauugccggagcacagaacuacacgaugaaucuggcuagucagaacuggaauaacuaugaucccacugaggaaaucccugccccacuuggcacacccgacuuuguugguaagauucagggggugcugacccaaacuacacggcgagacggaagcaccagaggccacaaagcuacggucucuaccggcuccgugcauuucacaccuaaguuggggucaguccaguuuagcacugauaccaguaaugacuucgagacaggacagaacacuagguuuaccccaguggguguugugcaagauggcucuacaacccaccagaaugaaccccagcaguggguacucccggacuacuccgggcgggauagccacaacguccaucuggccccugcaguggccccaacuuuccccggagagcaauuacuguuuuuccguucgacgaugccuggcuguucugguuaccccaauaugaaccucgacugccuucugccacaggaauggguucagcacuuuuaucaggaguccgcuccugcgcaaucagauguggcauugcuacgcuucgucaaucccgacacagggagagugcuguuugaguguaagcuccauaaaaguggcuacguaaccguggcccacacuggacagcacgaucugguuaucccaccgaacggcuauuucagguuugacagcuggaucaaccaguucuacacccuugcuccuauggggaauggagccggucggcgacgcuga

SEQ ID NO: 20744 - RNA, 1617 nt, Artificial Sequence
  derived and/or modified sequence opt3 from VP1__Norovirus_and/or_Norovirus-like__KP784691
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcacaacuacacuaugaaucucgcaagucagaacuggaauaacuaugaucccacagaggaaauuccugcuccacuggguacccccgacuucguagggaagauccagggaguucuuacucagacaacccggggcgacggcagcacgcgcgggcauaaggccaccgugucuacaggagaugcucacuuuacuccuaagcuggguuccgucauguucucaaccgacacaaauaacgauuuugagacuggccaaaauacccgauucacaccagugggggucgugcaggacggaagcaccacucaccagaacgaaccccaacaguggguuuugccgaguuaccucggcagagauucucauaaugugcaccuggccccugcaguagccccauccuuucccggugagcaguuacuguucuuuaggagcacgaugccuggguguucgggcuaccccaacaugaauauggacugccuccuuccacaggaauggguccaacauuucuaucaggaggcugcgccugcacagucugauguggcccuguugcgguuuguuaaccccgacacaggacgugugcuauucgaguguaaacugcacaaguccggcuacgucaccguggcucacacugggcagcaugaucucguaaucccaccgaacggauauuuucgcuucgacucaugggugaaucaauucuacacccuggccccuauggguaacggcacagggagaaggcgguga

SEQ ID NO: 20745 - RNA, 1617 nt, Artificial Sequence
  derived and/or modified sequence opt3 from VP1__Norovirus_and/or_Norovirus-like__KX907727
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccgucuuaacuguggaggaaaugacaaauagccgcuuuccaaucccccuggagaaacuuuucaccggaccuuccucagccuucguugugcagccacagaacgguagauguacgacugauggcgucuugcuggggaccacacaacuaaguccggugaauauaugcacuuuuaggggagacguaacccauauuacaggcagccggaacuacaccaugaaucucgcaucucagaacuggaauaacuaugaucccacggaggaaaucccugcuccacuggguacucccgacuucguugggaagauucagggaaugcuuacacagaccacucgcacagacggcuccacccgaggccacaaggccaucguguacacggggucagcugauuuugccccuaagcugggaagaguccaauucgagaccgacacagaucaugacuuugaagcaaaucagaacacuaaauucaccccagugggugucauccaggauggcagcacaacucacaggaaugagccccaacaguggguguugccgaguuacucugggcggaacacccacaauguucaucucgccccugcuguggcgccaacauuucccggagaacagcuguuauucuuucguuccaccaugccuggcuguagcgguuaucccaacauggaccuggauugccuccuuccacaggaguggguacaauacuucuaucaggaggcagccccugcucagucggacgucgcccuguugcgcuuugugaaucccgauacugggagaguucuauucgaauguaagcugcacaaaucuggcuacgugacggucgcacauacaggacagcacgaccucgugauuccaccgaacggcuauuuuagguucgauuccuggguaaaccaauucuacacccuggccccuauggggaauggaacuggucggcgacgcuga

SEQ ID NO: 20746 - RNA, 1617 nt, Artificial Sequence
  derived and/or modified sequence opt3 from VP1__Norovirus_and/or_Norovirus-like__KX354049
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccaucuuaacugucgaggaaaugacaaauagccgcuuuccaauaccccuggagaaacuuuucaccggaccuuccucagccuucgugguucagccacagaacgguagauguacgacugauggcguguugcuggggaccacacaacuaaguccggucaauauuugcacuuuuaggggagacgugacccauaucacaggcagccggaacuacaccaugaaucucgcaucucagaacuggaauaacuaugaucccacggaggaaauuccugcuccacuggguacucccgacuucguagggaagauccagggaguucuuacacagaccacucgcgccgacggcuccacacgaggccacaaggcuaccguguacacggggucagccgauuuugcaccuaagcugggaagaguccaauucgagaccgacacagaucaugacuuugaagccaaucagaacacuaaauucaccccagugggugucauccaggauggcgggacaacucacaggaaugagccccaacaguggguguugccgagcuacaguggacggaacacccacaauguucaucucgcuccugcgguggcaccaacauuucccggcgaacagcuguuauucuuucguucuaccaugccugguuguuccggguaucccaacauggaccuggauugccuccuuccacaggaguggguacaauacuucuaucaggaggccgcuccugcccagagcgacgucgcacuguugcgcuuugugaaucccgauacuggcagaguucuauucgaauguaagcugcacaaaucgggauacgugacggucgcccauacaggccagcacgaccucgugauuccaccgaacggguauuuuagguucgauucuuggguaaaccaauucuacacccuggcuccuaugggaaaugguacuggccggcgacgcuga

SEQ ID NO: 20747 - RNA, 1617 nt, Artificial Sequence
  derived and/or modified sequence opt3 from VP1__Norovirus_and/or_Norovirus-like__KX354024
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauacaaccggcagccggaacuacacgaugaaucucgcaucucagaacuggaauaacuaugaucccacugaggaaaucccugcuccacuggguacacccgacuucgucgggaagauacagggagugcuuacccagacuacacgcaccgacggcuccacgcgaggccacaaggccaccgucuacacagggucagcugauuuugccccuaagcugggaagagugcaauucgagacugacaccgaucaugacuuugaagcaaaucagaacacaaaauucacuccaguuggugugauucaggauggcagcaccacacacaggaaugagccccaacaguggguauugccgaguuacucugggcggaacacccacaauguccaucucgccccugcuguggcgccaacuuuucccggagaacagcuguuauucuuucguuccacgaugccuggcuguagcgguuaucccaacauggaccuggauugccuccuuccacaggaguggguucaauacuucuaucaggaggcagccccugcucagucggacguggcccuguugcgcuuugucaaucccgauacagggagagugcuauucgaauguaagcugcacaaaucuggcuacguaaccguggcacauacuggacagcacgaccucguuaucccaccgaacggcuauuuuagguucgauuccugggucaaccaauucuacacccuggccccuauggggaauggaacaggucggcgacgcuga

SEQ ID NO: 20748 - RNA, 1617 nt, Artificial Sequence
  derived and/or modified sequence opt3 from VP1__Norovirus_and/or_Norovirus-like__KX353955
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugaggcacaucaaaacaccaaguucacaccagugggggucauccaggacggaaguacuacccaccgaaaugaaccccagcaaugggugcucccgucuuacuccggcagaaacguucacaaugugcaucuggccccugcuguagcgccaacauuucccggugagcaguuacuguucuuuaggagcaccaugccuggguguucgggcuaucccaacauggaucucgacugccuucugccacaggaguggguccagcacuucuaccaagaagcagccccugcucagucugauguggccuugcuacgguuuguuaaucccgacacuggacgugugcuguucgaguguaaacuccauaaguccggcuaugucacgguggcacacacagggcagcacgaucugguaauuccaccgaacggauacuuucgcuucgacucaugggugaaccaguucuauacccuugccccuauggguaauggcacugggagaaggcgguga

SEQ ID NO: 20749 - RNA, 1617 nt, Artificial Sequence
  derived and/or modified sequence opt3 from VP1__Norovirus_and/or_Norovirus-like__AB972518
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcaguacuacccaucggaacgagccccaacaguggguauugccgucuuacuccgggcguacaaccccuaauguccaccucgccccagcuguggcgcccacuuuuccuggagaacagcuguuauucuuucgcagcacgaugcccggcuguucggguuauccaaacauggaccuggauugccuccuuccucaggaguggguucaauacuucuaucaggaggcagcccccgcucagucugacguggcccuguugagauuugucaauccagauacagggagggugcuauucgaauguaagcugcacaaauccggcuacguaaccguggcacauacuggacagcacgaccucguuauuccgccuaacggcuauuuucgguucgauucaugggucaaucaauucuacacccuggcccccauggggaacggaacaggucgacgcagauga

SEQ ID NO: 20750 - RNA, 1617 nt, Artificial Sequence
  derived and/or modified sequence opt3 from VP1__Norovirus_and/or_Norovirus-like__AB933744
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucaacuuucgugguucagccacagaacgguagauguaccacagauggcguguugcuggggacuacccaacuaaguccggucaauauuugcacauuuaggggagacgugacccauaucgcgggcagccggaacuacacgaugaaucucgccucucagaacuggaacuccuaugaucccacugaggaaauuccugcaccacuggguacacccgacuucguagggaagauccagggaguucuuacccagacuacacgcaccgacggcucaacgcgaggccacaaggcuaccguguacacagggagcgccgauuuuaguccuaagcugggaagaguccaauucgcuacugacaccgauaaugacuuugaugccaaucagaacacaaaauucacuccagugggugucauccaggacggcgggaccgcacauaggaaugagccccaacaguggguguugccgucuuacuccggacggaacacacacaauguucaccucgccccugcuguggcgccaaccuuucccggcgaacagcuguuauucuuucguagcacuaugccugguuguucgggguaucccaacauggaucuggacugccuccuuccacaggaguggguacaauacuucuaucaggaagcagccccugcucagucugaugucgcccuguugcgcuuugugaaucccgacacgggcagaguucuauucgaguguaagcugcauaaauccggauacgcaacaguggcccacaccggccagcaugaucucgucauuccaccgaacggguauuuuagguucgacucaugggugaaccaauucuacacucuggcuccuaugggaaaugguaccggccggcgacgcuga

SEQ ID NO: 20751 - RNA, 1617 nt, Artificial Sequence
  derived and/or modified sequence opt3 from VP1__Norovirus_and/or_Norovirus-like__AB933673
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggccagaucauuuucgccgcagugccuccaaacuuuccgacugagggccucucccccucucaaguaacgauguucccucauaucauaguugacgugcgccagcuggagccaguccuuaucccccugccugaugugcgaaauaacuuuuaucacuacaaucagucgaacgacucaaccauuaaauugaucgcuaugcucuauacaccacugcgugccaacaaugcgggggaagauguguucacugucagcugcagaguucugaccaggcccaguccggacuuugauuucauuuuucucgugccucccacaguagagucccggaccaagccauucacugugccuaucuuaacagucgaagagaugaccaacucucgcuuucccauaccacuggagaaacuuuucacgggacccagcuccgccuucgugguucagccucaaaaugguagauguacuaccgacggcguguugcuggggacaacucagcuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaaaggcgacggcucuacacgcgggcacaaggcuaccguguacacgggauccgcccccuuuaccccuaaguuggguucaguccaauucagcacagacacugaaaacgauuuugagacccaucagaauacaaaauucacuccagugggcgucauccaggacgggggaaccacacaccgaaacgaaccccaacagugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccaacauuucuaccaggaagcggcacccgcccagucggauguggcuuugcuacgguuuguuaacccagacacgggacgugugcuguucgaguguaagcuccacaaaucuggcuaugucacaguggcccauaccgggcagcacgaucugguaauuccgccuaacggauacuuucgcuucgacuccugggugaaucaauucuauacucuugcacccauggguaacggcaccgggagaaggcgguga

SEQ ID NO: 20752 - RNA, 1617 nt, Artificial Sequence
  derived and/or modified sequence opt3 from VP1__Norovirus_and/or_Norovirus-like__KM245070
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguggcgcccccuuuaccccuaaauuggggucuguccaguucuccacagacacugaaaacgauuuugagacccaucaaaauacaaaguucacuccagugggagucauccaggacggcucaaccacacaccgaaacgaaccccagcaaugggugcucccgagcuacagugguagaaauguucacaacgugcaucuggccccugcaguagcuccaaccuuucccggggagcaguuacuguucuuuaggucuacuaugccuggcuguuccggauaucccaauauggaucucgacugccuucugccacaggaguggguccagcacuucuaccaagaagcggccccugcacagagcgauguggcuuugcuacgguuuguuaaccccgacacgggccgugugcuguucgaguguaaacuccauaagucgggguaugucacaguggcccacaccggacagcacgaucugguaauuccaccgaacgguuacuuucgcuucgacucuugggugaaucaguucuauacucuugcaccuaugggcaacgggaccggaagaaggcgguga

SEQ ID NO: 20753 - RNA, 1617 nt, Artificial Sequence
  derived and/or modified sequence opt3 from VP1__Norovirus_and/or_Norovirus-like__EU921382
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccaguugaaugacucaaccauuaagcucaucgcuaugcuguauacaccacugcgugccaacaacgcgggggaagauguguucacugucagcugcagaguucucaccaggcccaguccggacuuugauuucauuuuucuggugccucccacaguagagucccggaccaaaccauucacugugccuauccugacagucgaagagaugaccaauucucgcuuucccauaccacuugagaaguuguucacgggacccagcggugccuucgugguucagccucagaacggcagauguacuaccgacggggugcugcuaggaacaacucaacucuccccagucaauauuugcaccuuuaggggcgaugugacacauaucgcagguucacgggacuacaccaugaaccuggcuagucuuaauuggaacaauuaugauccgacggaagagauucccgccccucuggggacuccagacuucguaggaaaaauccagggcguuuugacacagaccacuaagggcgacgggagcacacgcggacacaaggcuaccguguacacggguucugcccccuuuaccccuaaacucggcuccguccaguucucaacagauacugaaaacgacuuugagacccaucaaaauacaaaguucacuccagugggggucauccaggauggaagcaccacacaccgaaacgaaccccagcaaugggugcugccgaguuacucuggcagaaauguucacaacgugcauuuagccccugcaguagcuccaaccuuucccggugagcaguuacucuucuuuagguccacuaugccuggguguagcggcuaucccaauauggaccuugauugccuguugccacaggaguggguccagcacuucuaccaagaagcggccccugcacagucggacguggcucuacugcgguuuguuaaccccgauacgggacguguccucuucgaguguaaacugcauaagucuggcuaugugacaguggcccacaccgggcagcacgaccuuguaauuccaccgaauggauacuuucgcuucgauuccugggugaaccaguucuauacucuggcaccuauggguaacggcaccgggagaaggcgguga

SEQ ID NO: 20754 - RNA, 1617 nt, Artificial Sequence
  derived and/or modified sequence opt3 from VP1__Norovirus_and/or_Norovirus-like__KP293589
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggacauaccugcuccacuggguacucccgacuucgucgggaagauucagggagugcuuacacagaccacucgcacagauggcucaacccgaggccacaaggccacggucuacaccgggagcgcugacuuugccccuaagcugggaagagugcaauucgaaacagauacugaccaugauuuugaggcaaaccagaauaccaaauucacaccaguuggugugauccaggacggcaguacuacccacaggaacgaaccccaacaguggguauugccgucuuacuccgggcggaauacaccuaacguccaccucgccccagcuguggcgcccaccuuuccuggagagcagcuguuauucuuucguagcacuaugcccggcuguucggguuauccaaauauggaucuggacugccuccuuccucaggaauggguucaauacuucuaucaggaggcagcccccgcucagucugauguggcccuguugcgcuuugucaacccagacacggggagagugcuauucgaguguaagcugcauaaauccggcuacguaacaguggcacacaccggacagcaugaucucguuauuccgccuaauggcuauuuuagguucgacucaugggucaaccaauucuacacucuggcccccauggggaacggaaccggucggcgacgcuga

SEQ ID NO: 20755 - RNA, 1617 nt, Artificial Sequence
  derived and/or modified sequence opt3 from VP1__Norovirus_and/or_Norovirus-like__KP241908
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacuaaccacgauuuugaagcaaaucagaacaccaaauucacaccaguuggugugauccaggacggcaguacuacccacagaaaugagccccaacaguggguauugccgucuuacuccgggaggaacacaccuaauguccaucucgccccagcuguggcgcccaccuuuccuggagaacagcuguuauucuuucggagcacuaugcccggcuguucggguuauccaaacauggaucuggacugccuccuuccucaggaguggguucaauacuucuaucaggaggcagcccccgcucagucugauguggcccuguugcguuuugucaauccagacacggggcgcgugcuauucgaauguaagcugcacaaauccggcuacguaacaguggcacauaccggacagcacgaucucguuauuccgccuaacggcuauuuuagauucgacucaugggucaaccaauucuacacucuggcccccauggggaauggaaccgguaggcggcgauga

SEQ ID NO: 20756 - RNA, 1617 nt, Artificial Sequence
  derived and/or modified sequence opt3 from VP1__Norovirus_and/or_Norovirus-like__KJ451059
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugauagggacuuugaagcaaaucagaacaccaaauucacaccaguuggugugauccaggauggcucuacuacccaucggaaugagccccaacaguggguauugccguccuacagcgggcguaacacaccuaauguccaccucgccccagcuguggcgcccaccuuuccuggagaacagcuguuauucuuucgcucgacuaugcccggcuguucugguuauccaaacauggaccuggauugccuccuuccucaggaguggguucaauacuucuaucaggaggcagcccccgcucaguccgacguggcccuguugagauuugucaauccagauacggggagggugcuauucgaauguaagcugcacaaaucaggcuacguaacaguggcacauaccggacagcacgaccucguuauuccgccuaacggcuauuuucgguucgauaguugggucaaucaauucuacacucuggcccccauggggaacggaaccggucgacgcagauga

SEQ ID NO: 20757 - RNA, 1617 nt, Artificial Sequence
  derived and/or modified sequence opt3 from VP1__Norovirus_and/or_Norovirus-like__KM198570
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggggagcuccucugggcccagauuugaaccccuacuuaagccaccuggcccggauguauaaugguuacgcagggggauucgaagugcaggucauucuagcaggcaacgccuuuacagcuggcaaaaucauuuucgccgcagugccuccaaauuuuccgacugaggggcucucccccucucagguaacgauguucccucauaucauaguugacgugcgccaacuggagccaguccuuaucccccugccugaugugcgaaacaauuuuuaucacuacaaccagaccaaugacucgacaauuaaguugaucgcuaugcucuauacuccacugcgugccaacaacgcgggagaagauguguucaccgucucaugcagaguucugacaaggcccagcccggacuuugauuucauuuuucucgugccucccaccguagagagucggacuaaaccauucacagugccuaucuuaaccgucgaagagaugacuaauucccgcuuucccauaccacuggagaaacuuuucacgggucccucuggcgccuucgugguucagccucagaacgggagauguaccacagacggaguguugcugggcacuacccaacuaagcccagucaauauuugcacauuuaggggugaugugacccauaucgcagggucccggaacuacacgaugaaucucgcuucacugaacuggaauaacuaugacccgacugaagagauucccgccccucuuggaacaccagauuucguaggcaagauccagggcguucugacccagacuacaaagggggacggaaguacccgcggucacaaggcuacgguguacaccggcagcgcccccuuuacaccuaaauuggggucuguccaguucuccacugacaccgaaaaugauuuugagacacaucaaaacacuaaguucaccccagugggagucauccaggacggcgguacaacccaccgaaaugaaccccagcaaugggugcucccgucauacagcgggagagauguucacaacgugcaucuggcgccugccguagcuccaacuuuucccggcgagcaguuacuguucuuuaggaguacgaugccuggauguucuggcuaucccaauauggaccucgauugccuucugccacaggaguggguccagcacuucuaccaagaagcggccccugcacaguccgacguggcuuugcuacgguuuguuaaccccgauacagggcgugugcuguucgaguguaaacuccauaagagcggauaugucaccguggcccacaauggucagcacgaccugguaauuccaccgaacggcuacuuucgcuucgauucgugggugaaccaguucuauacucuugcaccuauggggaauggaaccggcagaaggcgguga

SEQ ID NO: 20758 - RNA, 1617 nt, Artificial Sequence
  derived and/or modified sequence opt3 from VP1__Norovirus_and/or_Norovirus-like__KM198558
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacccaacaauuaaguugaucgcuaugcucuauacuccccugcgugccaacaacgcgggggaagauguguucaccgucucaugcagaguucugacaaggccgagcccugacuuugauuucauuuuucucgugcccccaaccguagagagucggacuaaaccuuucacagugcccaucuuaaccgucgaagagaugacuaauucccgcuuuccaauaccccuggagaaacuuuucacgggaccuucuggugccuucgugguucagccacagaacggcagauguaccacagacgggguguugcugggaacuacccaacuaagcccggucaauauuugcacauuuaggggcgaugugacccauaucgcagguucccgggacuacacgaugaaccucgcuucacugaauuggaacaauuaugaucccacugaagagauuccugccccacuugggacacccgacuucguaggaaagauccagggcguucugacccagacuacacgcggcgacgggaguacccgaggacacaaggcuacgguguacaccgguagcgccccuuuugcaccaaaguugggcucuguccaguucuccacagauacugaaaacgacuuugagacccaucaaaauacaaaauucacucccgugggggucauccaggauggaggcaccacacacagaaacgaaccgcagcaaugggugcucccuucauacagcgguagggacguucacaaugugcaucuggccccagcuguagcgcccaccuuuccuggggagcaguuacuguucuuucggaguacuaugcccggcuguucuggauauccaaacauggaucucgacugccuucugccucaggaguggguccagcacuucuaccaagaagcagcccccgcucaguccgauguggccuugcuacguuuuguuaauccagacacgggccgcgugcuguucgaguguaagcuccauaaaagcggguaugucacaguggcacacaccggacagcacgaucugguaauuccgccuaacgguuacuuuagauucgacucgugggugaaucaguucuauacucuugcccccaugggcaacgggaccggaaggcggcgauga

SEQ ID NO: 20759 - RNA, 1617 nt, Artificial Sequence
  derived and/or modified sequence opt3 from VP1__Norovirus_and/or_Norovirus-like__AB447456
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaaaauccagggccuguugacacagaccacuaagggcgacgggagcacacgcggacacaaggcuaccguuuacacggguucugcccccuuuaccccuaaacucggcuccgugcaguucucaacagacacugaaaacgauuuugagacccaucaaaauacaaaguucacuccagucggggugauccaggacggaagcaccacacaccgaaacgaaccccagcaauggguccugccgaguuacucuggcagaaaugugcacaacguucauuuagccccugcaguggcuccaaccuuucccggugagcagcuucucuucuuuagguccacuaugccuggguguagcggcuaucccaauauggaucuugacugccuguugccacaggaguggguacagcacuucuaccaagaagcggccccugcacagucggaugucgcucuacugcgguuugugaaccccgacacgggacguguucucuucgaguguaaacugcauaagucuggcuaugugacagucgcccacaccgggcagcacgaucuugugauuccaccgaacggauacuuucgcuucgacuccuggguaaaucaguucuauacucuggcaccuauggguaacggcaccgggagaaggcgguga

SEQ ID NO: 20760 - RNA, 1617 nt, Artificial Sequence
  derived and/or modified sequence opt3 from VP1__Norovirus_and/or_Norovirus-like__KF177444
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauugugaucgacguccgccaacuggagccagugcuuauaccccugccugaugugcgaaauaacuuuuaucacuacaaucagagcaacgacccaaccaucaaguugauugcuaugcucuauacaccccugcgugccaauaacgcgggggaugacgucuucacuguuaguugcagagugcugaccaggccguccccugauuuugacuucaucuuucucguacccccaacaguggaaucucggaccaaaccuuucagcguccccguguuaacuguugaggaaaugacaaacucccgcuuuccaauuccccuggagaaacuuuucaccggaccuucaagugccuucgugguccagccacagaaugguagauguacgacugauggcguguugcuggggaccacacaacuaagcccgguaaacaucugcacuuuuaggggagacguuacccauauaacaggcucucggaauuacaccaugaaccucgcaucccagaauuggaacaauuaugaucccacggaggaaauuccugcuccacuggguacucccgacuucguggggaagauccagggaguccuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauucaggauggcaguacuacccacaggaacgagccccaacaguggguguugccgucuuacuccgggcggaauacaccuaacguacaccucgccccagcugucgcgcccaccuuuccuggagaacagcuguuauucuuucguagcacuaugcccggcuguucggguuauccaaauauggaccuggauugccuccuuccucaggagugggugcaauacuucuaucaggaggcagcccccgcucagucugacguugcccuguugcgcuuugugaacccagauacggggagaguccuauucgaauguaagcugcauaaauccggcuacgugacaguagcacacaccggacagcaugaccucgugaucccgccuaauggcuauuuuagguucgauucauggguuaaccaauucuacacucuggcccccauggggaacggaaccggucggcgacgcuga

SEQ ID NO: 20761 - RNA, 1617 nt, Artificial Sequence
  derived and/or modified sequence opt3 from VP1__Norovirus_and/or_Norovirus-like__KF429776
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccuaucuuaacugucgaggaaaugacaaacagccgcuuucccauaccacuggagaaacuuuucaccggacccuccucaacguucgugguucagccucagaaugguagauguacuaccgauggcguguugcuggggacaacucaacuaaguccagucaacauuugcaccuuuaggggagacgugacacauaucgccggcagccggaauuacaccaugaaccucgcaucucagaauuggaacuccuaugauccgacggaggaaauucccgcuccucuggguacuccagacuucguagggaagauccagggaguucuuacacagaccacucgcacagacggcucaacccgaggccacaaggccacgguguacaccgggagcgcugauuuuagucccaagcugggaagaguccaauucgccacagacacugauaaugacuuugaugcaaaccagaauaccaaauucacaccugugggugucauccaggacggcgggacugcccauaggaacgagccacaacaguggguguugcccucuuacuccggacggaauacccacaacguucaccucgcuccggcgguggcaccuacauuuccaggcgaacagcuguuauucuuucguagcaccaugcccgguuguucgggguauccuaauauggaucuggacugccuccuuccccaggaguggguacaauacuucuaucaggaagccgcuccagcccagucugaugucgcacuguugcgcuuugugaacccugacacuggcagaguucuauucgaguguaagcugcauaaacccggauacgugacggucgcccacacaggccagcaugaucucgugauuccaccgaacggguauuuuagguucgacuccuggguaaaucaauucuacacccuggcuccuaugggaaacgguacuggccggcgacgcuga

SEQ ID NO: 20762 - RNA, 1617 nt, Artificial Sequence
  derived and/or modified sequence opt3 from VP1__Norovirus_and/or_Norovirus-like__KC243078
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggaggcagccccugcucagagcgaaguggcccuguugcgcuuugucaaucccgacacgggcagagugcuauucgaguguaagcugcacaaaucgggauacguaacaguggcacauaccggccaguaugaucucguuauuccaccgaacggguacuuuagguucgacucuugggucaaccaauucuauacucuggccccuaugggaaaugguaccggccggcgacgcuga

SEQ ID NO: 20763 - RNA, 1617 nt, Artificial Sequence
  derived and/or modified sequence opt3 from VP1__Norovirus_and/or_Norovirus-like__KC409280
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaaggaagacggcagcacccgcgggcacaaggcuacgguguacaccggaucugcccccuuuacaccuaaauuggguuccguccaguucucaacugacaccgagaaugauuuugaaacacaucaaaacacuaaguucaccccagugggcgucauccaggacgggggaacaacccaccgaaaugagccccagcaaugggugcucccgagcuacaguggcagagauguucacaacgugcaucuggccccugcaguagcuccaacuuuucccggugagcagauuuuauucuuuaggucuacgaugccuggguguuccggcuaucccaauauggaccuggauugccuccuuccacaggaauggguccagcacuucuaccaagaggcggccccugcacagagcgacguggcucuguugcgguuuguuaaccccgauacaggacgugugcuauucgaauguaaacugcauaagucgggcuaugucaccguggcccacacugggcagcacgaccucguaauaccaccgaauggauacuuucgcuucgauucuugggugaaccaguucuauacccuggcaccuauggguaacggcacagggagaaggcgguga

SEQ ID NO: 20764 - RNA, 1617 nt, Artificial Sequence
  derived and/or modified sequence opt3 from VP1__Norovirus_and/or_Norovirus-like__KC175357
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacauggaucucgacugccuucugccucaggaguggguccagcauuucuaccaagaagcggcacccgcccagucugauguggcuuugcuacgguuuguuaauccagacacgggacgugugcuguucgaguguaaacuccacaaguccggcuaugucacaguggcccauaccgggcagcacgaucugguaauuccgccuaacggauacuuucgcuucgacucaugggugaaccaguucuauacucuugcacccauggguaauggcaccgggagaaggcgguga

SEQ ID NO: 20765 - RNA, 1617 nt, Artificial Sequence
  derived and/or modified sequence opt3 from VP1__Norovirus_and/or_Norovirus-like__JX459621
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguccggucaauauuugcaccuuucggggagacguggcccauaucgcaggcacacaggaguacaccaugaaccucgcuagccagaauuggaacaauuaugaucccacggaagagauuccugccccacuggguacucccgacuucguagggaagauccagggaguucuuacacaaaccacucgccgagacggcucuacaagaggccacaaagcuaccguguccacggggucaguccauuuuaccccuaagcugggaaggauccaguucagcacagauacuagcaacgacuuugaaaccggucagaauacacgguucacuccagugggcgucgugcaagaugggggaaccacacaccagaacgagccccagcaguggguuuugccggacuacucuggccgugauucccacaaugugcaucucgccccugcaguagccccaaguuuucccggugaacaacuguuauucuuucgcucgaccaugccuggguguucuggcuaccccaacaugaaucuggacugccuccuuccacaggaguggguccagcacuucuaucaggaggcugcgccugcacaauccgauguggcccuguugagauuuguuaaccccgacacuggaagggugcuauucgaauguaagcugcauaaaucaggcuacgucacgguggcucacacagggcagcacgaucucguaauuccaccgaauggauauuuucgguucgacaguugggugaaccaguucuacacccuggccccuauggguaacggcacugggcgacgcagauga

SEQ ID NO: 20766 - RNA, 1617 nt, Artificial Sequence
  derived and/or modified sequence opt3 from VP1__Norovirus_and/or_Norovirus-like__JQ613541
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucguguucgcuguaguuccuccaaauuuuccgacggagggccucucucccucacaggugaccauguucccucauauuaucgucgacgugcgccaacuggagccagugcuuauaccccugccugauguccgaaacaauuuuuaucacuacaaccagucgaaugacccaacaaucaaguugauugccaugcucuauacuccccugcgugcaaacaacgcuggggaugacguuuucaccgugagcugcagaguacugacaaggccgaguccugauuuugacuucaucuuucucgugcccccaaccgucgaaucccggacuaaaccuuucucugugcccauuuuaacaguugaggaaaugaccaauagccgcuuuccaaucccccuggagaaacuuuucacgggaccuuccucagccuucgugguccagccacagaacgguagauguacuaccgauggcguguugcuggggacaacucaacuaaguccgguaaauauaugcaccuuuaggggagacguuacacauauugcgggcagccacaacuacaccaugaaucucgccucucagaacuggaacuccuaugaucccacggaggaaaucccugcaccacuggguacucccgacuucguggggaagauucagggaguccuuacacagaccacucggacagacggcucaacccgcggccauaaggcuacgguguacaccgggagcgccgaguuuaguccuaagcugggacgaguccaauucgcuacagauacuaauaaugacuuugaugccaaccagaauaccaaauucacaccaguggguguuauccaggacggcgggacuacccacagaaacgaaccccaacaguggguguugccgucuuacuccggaaggaauacacacaacguacaucucgccccugcagucgcuccaaccuuucccggcgagcagcuguuauucuuucggagcacuaugccugguuguucgggguaucccaauauggaucuggacugccuccuuccacaggaaugggugcaauacuucuaucaggaggcggccccugcacagucugauguugcucuguugcguuuugugaaccccgacacgggccgcguccuauucgaguguaagcugcacaaauccggauacgugacaguagcccauaucggccagcacgaucucgugauuccaccgaacggguauuuuagauucgacucauggguuaaucaauucuacacccuggcaccuaugggaaacgguacuggcaggcggcgauga

SEQ ID NO: 20767 - RNA, 1617 nt, Artificial Sequence
  derived and/or modified sequence opt3 from VP1__Norovirus_and/or_Norovirus-like__JQ613527
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccugggugagaaauaacuucguucaggcuccugguggcgaauuuacagugaguccaaggaaugcacccggggagauacuuuggagcgccccucugggaccagauuugaaccccuacuuaucccaccuggcucggauguauaauggcuacgccgguggguucgaaguccaggugauccuagcgggaaacgcauuuacugccggcaaaauuaucuucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccauuuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauugccggcagccacaacuacaccaugaaucucgcaucucagaacuggaacuccuaugaucccacggaggaaaucccugcuccacuggguacucccgacuucguugggaagauucagggagugcuuacacagaccacucggacagacggcucaacccgcggccauaaggccacggucuacaccgggagcacagaguuuaguccuaagcugggacgagugcaauucgcuacugauaccaauaaugacuuugaugccaaccagaauacaaaauucacuccagucggugugauccaggacggcgggaccacacacagaaacgaaccccaacaguggguuuugccgucuuacuccggaaggaauacccacaacgugcaucucgccccugcaguagcuccaacuuuucccggcgagcagcuguuauucuuucggagcacgaugccugguuguucgggguaucccaauauggaucuggacugccuccuuccacaggaauggguccaauacuucuaucaggaggcggccccugcacagucugauguggcucuguugcguuuuguuaaccccgacacaggccgcgugcuauucgaguguaagcugcacaaauccggauacgucaccguggcccauacuggccagcacgaucucguaaucccaccgaacggguauuuuagauucgacucaugggugaaucaauucuacacccuggcaccuaugggaaacgguacaggcaggcggcgauga

SEQ ID NO: 20768 - RNA, 1617 nt, Artificial Sequence
  derived and/or modified sequence opt3 from VP1__Norovirus_and/or_Norovirus-like__JF827296
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacguguuuacggcaggcaaaaucauuuucgccgcuguaccuccaaauuuuccgaccgagggccucucccccucucagguuacaauguucccucauaucauaguggacguccgccaacuggagccagugcuuaucccccugccugaugugcgaaacaauuuuuaucacuacaaccagucgaaugacccaacuauuaaguugaucgccaugcucuauacgccccugcgugcaaacaacgcuggggaugacgucuucacaguuucaugcagagugcugaccaggccgagcccugauuuugacuucauuuuucucgcgcccccaacuguagaaagucggacaaaaccuuucuccgugcccaucuuaaccgucgaggaaaugaccaauucucgcuuuccaauaccccuggagaaacuuuucacuggaccuagcuccgccuucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucaauccaguucagcaccgauacaaguaaugacuuugagacuggucagaacaccagauucacaccagugggcgucgugcaagaugggucuaccacucaccagaaugaaccccagcaguggguuuugccggacuacuccggaagggauagccacaacgugcaucucgcuccugccguagcaccaacguuucccggcgagcaacuguuauucuuucggucgacaaugccugguuguucuggguaccccaauaugaaccuggacugccuccuuccacaggaauggguccagcacuucuaucaggaguccgccccugcucaaucagauguggcgcuguugcguuuuguuaaucccgacaccggccgcgugcuauucgaguguaaacugcauaagaguggauacgucacuguggcacacaccggccagcacgaucucguaauuccaccgaacggguauuuuagauucgacagcugggugaaccaguucuacacacuggccccuaugggaaauggugcuggcaggcggcgauga

SEQ ID NO: 20769 - RNA, 1617 nt, Artificial Sequence
  derived and/or modified sequence opt3 from VP1__Norovirus_and/or_Norovirus-like__JF713050
augaagauggccagcaacgacgcuaaucccuccgauggcucugcagccaaccuggugccugaggucaauaacgaaguuauggcgcucgagccaguggcuggggccgcacuugccgcuccgguagcaggacagcaaaaugugaucgaccccuggauuagaaacaauuucguccaggccccugguggcgaauuuaccgugucaccaaggaacgcucccggggagauacuguggagugccccuuugagcccagauuuaaaucccuaccugucccaccuagcgcggauguauaacucuuacgcaggaggcuucgaaguucaggugauccucgccgguaaugcuuuuacagccgggaaaauuaucuucgcagcugucccuccaaacuuuccgauugagggacugucgcccucacaggugacuauguucccucauaucauaguagacguucgccaacuugagccagugcugauccccuugccugauguccgaaauaacuuuuaucacuacaaucagagcaacgaaccaacgauuaagcucaucgccaugcuguauacccccuuacgugcgaacaaugccggcgaggacguguucacagugaguugcagaguccucacuaggccguccccugauuuugacuucauuuuucugguucccccaaccguggaaucucggacaaaaccuuucaccguacccauccugacuguggaggagaugacaaacagccgcuuuccaauaccccuugaaaaguuguucaccggcccuuccucaaguuucgucgugcagccacagaaugggagauguacgacugauggaguucugcuagguaccacacaacucagcccggugaacauuugcacuuuuaggggcgacgucacccauaucgcagggucucggaauuacacaaugaaccuggcuuccauuaauuggaacaauuaugaucccaccgaggaaaucccugccccacuuggaacgcccgacuucgugggcaaaauccaggguaugcugacucagacaacccgcggggauggaucaacucgaggccacagagcuacaguauacaccggcagcgccccuuuuacgccaaaguuggggaguguucaguucaccacagacacugacaacgauuuugagaccaaucaaaacacaaaguucacucccgugggagucgugcaggacggugauaccgcacauaggaaugaaccgcagcaauggguccucccuucuuacuccggccggaacgugcagaauguucaccuggccccagcuguggcgcccacauuuccuggggagcaguuacuguucuuucguagcaccaugcccggauguucgggcuauccaaacauggaccucgauugccuucugccucaggaguggguacaacacuucuaccaggaagcagcccccgcucagucugacgucgccuugcuacgcuuugugaacccagauacugguagaguucuguucgaguguaaacuccauaaguccggguaugugacggucgcacacacaggccagcaugaccuggugauuccgccuaauggauacuuuagguucgauucauggguaaaccaauucuauacccuugcccccaugggcaaugggacuggacggcgacgcuga

SEQ ID NO: 20770 - RNA, 1617 nt, Artificial Sequence
  derived and/or modified sequence opt3 from VP1__Norovirus_and/or_Norovirus-like__HM802548
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggagcuaccgcaugaaccucgccucucagaauuggaacaauuaugaucccacugaggaaauuccugcaccacuggguacacccgacuucguagggaagauccagggaaugcuuacccagacuacaaagcgagacggcuccaccagaggccacaaggcuacgguuucaaccgggagcguggauuuuacaccuaaacugggaaguguccaauucgccacugacaccgauaacgacuuugagacaggucagaauacuagguucaccccagugggcgucauccaggaugggucuuccacacaucggaacgaaccccaacaguggguguugccggacuacagcggacguaccguucacaaugugcaccucgcuccugccguagcaccaacuuuucccggcgagcagcuguuauucuuucgcucgacgaugccugguuguucuggguaccccaacauggaucuggacugccuccuuccacaggaauggguccaacauuucuaucaggaggccgcuccuucccagucagauguggcgcuguugagauuuguuaaucccgacacaggcagggugcuauucgaguguaagcugcacaaagcaggauacgucaccguggcccauacuggccagcacgaucucguaauuccaccgaacggguauuuucgguucgacaguugggugaaucaauucuacacccuggcuccuaugggaaacggugccggccgacgcagauga

SEQ ID NO: 20771 - RNA, 1617 nt, Artificial Sequence
  derived and/or modified sequence opt3 from VP1__Norovirus_and/or_Norovirus-like__GQ856459
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcagaugauucuagcaggaaaugccuuuacagcuggcaaaaucauuuucgccgcagucccuccaaacuuuccgacugagggccucucccccucucaggugacgauguucccucauaucauaguagacguucgccaacuggagccagugcuuaucccccugccugauguccgaaauaacuuuuaucacuacaaucagucgaacgacucaaccauuaaguugaucgcuaugcucuauacaccacugcgugccaacaaugcgggggaagauguguucacugugagcugcagaguccugaccaggcccaguccggacuuugauuucauuuuucucguuccucccacaguggagucccggaccaaaccauucacuguaccuaucuuaacaguggaagagaugaccaacucucgcuuucccauaccacuggagaaacuuuucacgggacccagcuccgccuucgucgugcagccucagaaugguagauguacuaccgacggcguuuugcuggggacaacucaacuaucaccagugaacauuugcaccuuuaggggagaugucacacauaucgcaggcagucggaauuacaccaugaaccucgcuagccugaauuggaacaauuaugacccgacggaagagauucccgccccucuugguacuccagauuucguggggaagauccagggaguacugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggggaaccacacaccgaaacgaaccccagcaauggguccucccgaguuacucuggcagaaaugugccuaacguucaccuggcaccagccguggcucccaccuuuccuggugagcaguuacuguucuuuagguccacuaugcccggguguagcggcuauccaaauauggaucucgacugccuucugccucaggaguggguacagcauuucuaccaagaagcggcacccgcccagucggaugucgcuuugcuacgguuugugaacccagacacgggacguguucuguucgaguguaaacuccacaagucuggcuaugugacagucgcccauaccgggcagcacggacuggugauuccgccuaacgguuacuuucgcuucgauuccuggguaaaucaguucuauacucuugcacccaugggcaacgggaccggaagaaggcgguga

SEQ ID NO: 20772 - RNA, 1617 nt, Artificial Sequence
  derived and/or modified sequence opt3 from VP1__Norovirus_and/or_Norovirus-like__AB541308
augaagauggccagcaacgacgcuaaucccuccgauggcucugcagccaaccuggugccugaggucaauaacgaaguuauggcgcucgacccagugguaggggcugccaucgcagccccgguggcuggacagcaaaaugucauugaucccuggauaagaaacaauuucgugcaggcaccugguggcgaguuuaccguuucaccaaggaacgcccccggggaaauccuuuggagugcuccucugggaccagacuugaaucccuacuuaagccaccuggcccggauguauaacggcuacgcggguggguucgaggugcaggucauucuagcaggaaaugccuuuacagcuggcaaaaucauuuucgccgcagugccuccaaacuuuccgacugaaggccucucccccucucagguaacgauguucccucauaucauaguugaugugcgccaacuggagccaguccuuaucccccugccugacgugcgaaauaacuuuuaucacuacaaucagucgaacgauucaaccauuaaguugaucgcuaugcucuauacaccacugcgugccaacaaugcgggggaggacguguucacugucagcugcagaguucugaccaggcccaguccggauuuugacuucauuugucucgugccucccacaguagaaucccggaccaaaccauuuacugugccuaucuuaacagucgaggaaaugaccaacucucgcuuccccauaccacuggagaaacuuuuuacgggacccagcuccgccuucgugguucagccucagaaugguagaugcacuaccgauggcguguugcuggggacaacucaacuaucaccagucaacauuuguaccuucaggggagacgugacacauaucgcaggcagucggaauuacaccaugaaccucgcuagccugaauuggaacaauuaugauccgacggaggaaauucccgccccucuugguacuccagacuuuguagggaagauccagggaguucugacacagaccacuaagggcgacggcucuacacgcgggcacaaggcuaccguguacacgggauccgcccccuucaccccuaaauuggguucaguccaguuuagcacagauacugagaacgacuucgaaacccaucaaaauacaaaguuuacuccagugggcgucauccaggaugggggaaccacacaccgaaacgagccccagcaaugggugcucccgaguuacucuggcagaaauguuccuaacgugcaccuggcaccagccguagcucccaccuucccuggugaacaguuacuguuuuucagguccacuaugcccgggugcagcggcuauccaaauauggaccucgauugucuucugccucaggaguggguccagcauuuuuaccaagaggcggcacccgcccagucggacguggcuuugcuacgguucguuaacccagauacgggacgugugcuguuugaaugcaaacuccacaagucuggcuaugucacaguggcccauaccgggcagcacgaccugguaauuccgccuaacggauacuuccgcuuugauuccugggugaaucaguucuauacucuugcacccauggguaacggcaccgggagaaggcgguga

SEQ ID NO: 20773 - RNA, 1617 nt, Artificial Sequence
  derived and/or modified sequence opt3 from VP1__Norovirus_and/or_Norovirus-like__AB541276
augaagauggccagcaacgacgcuaaucccuccgauggcucugcagccucacuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagagcaacgacaguaccauuaaguugaucgcuaugcucuauacaccacugcgugccaauaacgcgggggaagauguguucacugucuccugcagaguucugaccaggcccucuccggacuuugauuucauuuuucucgugccucccacaguagagagccggaccaaaccauucacugugccuaucuuaacagucgaagagaugaccaacucccgcuuucccauaccacuggagaaacuuuucacgggacccucaggugccuucgugguucagccucagaauggcagauguacuaccgacgggguguugcugggaacaacucaacuaaguccagucaacauuugcaccuuuaggggcgaugugacacauaucgcagguagccggaauuacaccaugaaccucgcuucucugaauuggaacaauuaugacccgacggaagagauucccgccccucuugggacuccagauuucguaggaaagauccagggcguucugacacagaccacuaagggcgacggguccacacgcggacacaaggcuaccguguacacggguucagcccccuuuaccccuaaauugggcagcguccaguucaguacagacacugaaaacgauuuugagacccaucaaaauacaaaguucacuccagugggggucauccaggacggaucuaccacacaccgaaacgaaccccagcaaugggugcucccguccuacagcggcagagauguucacaaugugcaucuggccccugcaguagcuccaaccuuucccggugagcaguuacuguucuuuaggucgacuaugccuggguguucuggcuaucccaacauggaccucgauugccuucugccacaggaguggguccagcacuucuaccaagaagcggccccugcacaguccgacguggcuuugcuacgguuuguuaaucccgauacgggacgugugcuguucgaguguaaacuccauaagucaggcuaugucacaguggcccacaccgggcagcacgaccugguaauuccaccgaacggauacuuucgcuucgauaguugggugaaucaguucuauacucuugcaccuauggguaacggcaccgggagaaggcgguga

SEQ ID NO: 20774 - RNA, 1617 nt, Artificial Sequence
  derived and/or modified sequence opt3 from VP1__Norovirus_and/or_Norovirus-like__AB541224
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacauggaucucgacugccuucugccucaggaguggguccagcauuucuaccaagaagcggcacccgcccagucugauguggcuuugcuacgguuuguuaauccagacacgggacgugugcuguucgaguguaaacuccacaaguccggcuaugucacaguggcccauaccgggcagcacgaucugguaauuccgccuaacggauacuuucgcuucgacucaugggugaaccaguucuauacucuugcacccauggguaauggcaccgggagaaggcgguga

SEQ ID NO: 20775 - RNA, 1617 nt, Artificial Sequence
  derived and/or modified sequence opt3 from VP1__Norovirus_and/or_Norovirus-like__AB504330
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucugauaccccuugagaaguuguucacuggaccaagcggugccuucgugguucagccccagaauggcagauguaccacagacggggugcugcuaggaacuacccagcucuccccugucaacauuugcacauuuaggggcgaugugacccauaucgcagguucacggaauuacacgaugaaccuggcuagucuuaauuggaacaauuaugacccaacugaagagauuccggcuccccuggggacaccugauuucguaggaaaaauccaaggcguuuugacccagacuacaaagggcgacgggagcacccgcggacacaaggccacgguguacaccgguucugccccauuuacacccaaacucggcuccguccaguucucaacugacaccgaaaacgauuuugagacacaucagaauacuaaguucaccccugugggggucauccaagacggaagcacaacccaccgaaacgaaccacagcagugggugcugcccaguuacucuggcagaaauguucacaacgugcauuuagcaccggccguagcuccuacuuuuccaggugagcaacuccucuucuuuagguccacgaugcccggguguagcggcuauccuaauauggaucuugacugccuguugccccaggaguggguccagcacuucuaccaggaagcggcaccagcccaaucggauguggcucuacugcgguuuguuaacccugacacaggacgugugcuguucgaguguaaacugcauaagucuggcuaugucaccguggcccacacugggcagcacgaucuuguaauucccccaaacggauacuuucgcuucgacuccugggugaaucaguucuauacccuggcaccgauggguaacggcacagggagaaggcgguga

SEQ ID NO: 20776 - RNA, 1617 nt, Artificial Sequence
  derived and/or modified sequence opt3 from VP1__Norovirus_and/or_Norovirus-like__AB447445
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugacggccucucccccucucagguaacgauguucccucauaucauaguugaugugcgccaacuggagccaguccuuaucccccugccugacgugcgaaauaacuuuuaucacuacaaucagucgaacgauucaaccauuaaguugaucgcuaugcucuauacaccacugcgugccaacaaugcgggggaggacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugagaacgacuuugaaacccaucaaaauacaaaguucacuccagugggcgucauccaggaugggggaaccacacaccgaaacgagccccagcaaugggugcucccgaguuacucuggcagaaauguucacaacgugcaucuggccccugcaguagcuccaaccuuucccggugaacaguuacuguucuuuagguccacuaugccuggguguagcggcuaucccaauauggaccucgauugccuucugccacaggaguggguccagcacuucuaccaagaggcggccccugcacagucggacguggcuuugcuacgguuuguuaaccccgauacgggacgugugcuguucgaauguaaacuccauaagucuggcuaugucacaguggcccacaccgggcagcacgaccugguaauuccaccgaacggauacuuucgcuucgauuccugggugaaucaguucuauacucuugcaccuauggguaacggcaccgggagaaggcgguga

SEQ ID NO: 20777 - RNA, 1617 nt, Artificial Sequence
  derived and/or modified sequence opt3 from VP1__Norovirus_and/or_Norovirus-like__AB294793
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcaugcugacacagaccacuaagggcgacgggagcacacgcggacacaaggcuaccguuuacacggguucugcccccuuuaccccuaaauugggcuccgugcaguucucaacagacacugaaaacgauuuugagacccaucaaaauacaaaguucacuccagucggggugauccaggacggaagcaccacacaccgaaacgaaccccagcaauggguccucccgaguuacucuggcagaaaugugcacaacguucaucuggccccugcaguggcuccaaccuuucccggugagcaguuacuguucuuuagguccacuaugccuggguguagcggcuaucccaauauggaucucgacugccuucugccacaggaguggguacagcacuucuaccaagaagcggccccugcacagucggaugucgcuuugcuacgguuugugaaccccgacacgggacguguucuguucgaguguaaacuccauaagucuggcuaugugacagucgcccacaccgggcagcacgaucuggugauuccaccgaacggauacuuucgcuucgacuccuggguaaaucaguucuauacucuugcaccuauggguaacggcaccgggagaaggcgguga

SEQ ID NO: 20778 - RNA, 1617 nt, Artificial Sequence
  derived and/or modified sequence opt3 from VP1__Norovirus_and/or_Norovirus-like__AB303934
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccaaguucacaccagucggagugauucaggauggcaacggugcucaccaaaaugagccccagcagugggucuugccgucuuacuccgggagaaccggccauaacgugcaccucgccccugcaguugccccaacuuuucccggagaacagcuguuauucuuuaggucaacgaugccuggcuguagcggguaccccaacaugaaucuggacugccuccuuccacaagagugggugcagcauuucuaucaggaggcugcgccugcacagagugauguagcccuguugcgguuugucaaccccgacacaggacgugugcuauucgaauguaaacugcacaagucugguuacauaaccguugcucacacuggccaacaugaucucgugaucccaccgaauggguauuuucgcuucgacuccugggucaaccaguucuacacccuggccccuaugggaaauggcacagguagaaggcgguga

SEQ ID NO: 20779 - RNA, 1617 nt, Artificial Sequence
  derived and/or modified sequence opt3 from VP1__Norovirus_and/or_Norovirus-like__KU678205
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaaggugcagggaguccuuacacagaccacucggacagacggcucaacccgcggccauaaggccacgguguacaccgggagcgcugauuuugccccuaagcugggacgaguucaauucgagacagacacuaaccacgauuuugaagcaaaucagaacaccaaauucacaccaguggguguaauucaggacggcgggacuacccacagaaaugagccccaacagugggucuugccgaguuacucuggaaggaacacaccuaaugugcaucucgccccagcuguugcgcccaccuuuccuggcgaacagcuguuauucuuucgguccacuaugcccgguuguagcggguauccaaacauggaucuggacugccuccuuccucaggagugggugcaauacuucuaucaggaggcagcccccgcucagucggaugucgcccuguugcguuuugugaauccagacacgggccgcguacuauucgaauguaagcugcacaaaucuggauacgugacaguugcacauaccggccagcacgaucucgucaucccgccuaacggguauuuuagauucgacuccugggugaaccaauucuacacucuggcccccaugggaaaugguaccggcaggcggcgauga

SEQ ID NO: 20780 - RNA, 1617 nt, Artificial Sequence
  derived and/or modified sequence opt3 from VP1__Norovirus_and/or_Norovirus-like__LC177657
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggaaugcuuacacagaccacucgcacagacggcuccacccgaggccacaaggccacgguguacaccgggucagcugauuuugccccuaagcugggaagaguccaauucgagacagacacugauagggacuuugaagcaaaucagaacaccaaauucacaccaguggguguuauccaggauggcagcacuacccaucggaaugagccccaacaguggguguugccgaguuacucugggcguaacacaccuaauguacaccucgccccagcugucgcgcccaccuuuccuggagaacagcuguuauucuuucgcuccacuaugcccggcuguagcgguuauccaaacauggaccuggauugccuccuuccucaggagugggugcaauacuucuaucaggaggcagcccccgcucagucggacguugcccuggugagauuugucaauccagauacggggaggguguuguucgaauguaagcuacacaaaucuggcuacguaacaguggcacauaccggacagcacgaccugguuauuccgccuaacggcuauuuucgguucgauuccugggucaaccaauucuacacucucgcccccauggggaauggaaccggucgacgcagauga

SEQ ID NO: 20781 - RNA, 1617 nt, Artificial Sequence
  derived and/or modified sequence opt3 from VP1__Norovirus_and/or_Norovirus-like__LC177656
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauacaaccggcagccacaacuacacgaugaaucucgcaucucagaacugguccaauuaugaucccacugaggaaaucccugcuccacuggguacacccgacuucgucgggaagauacagggagugcuuacccagacuacacggauugacggcucaacccgcggccauaaggccacggucuacaccgggagcgcugauuuugccccuaagcugggacgagugcaauucgagacagacacugaucacgacuuugaagcaaaccagaguaccaaauucacaccaguuggugugauccaggauggcucuacuacccacagaaaugagccccaacaguggguauugccguccuacagcgggaggaacacaccuaauguccaucucgccccagcuguggcgcccaccuuuccuggagaacagcuguuauucuuucggucgacuaugcccggcuguucugguuauccaaacauggaccuggauugccuccuuccucaggaguggguucaauacuucuaucaggaggcagcccccgcucaguccgacguggcccuguugcguuuugucaauccagauacggggcgcgugcuauucgaauguaagcugcacaaaucaggcuacguaacaguggcacauaccggacagcacgaccucguuauuccgccuaacggcuauuuuagauucgauaguugggucaaucaauucuacacucuggcccccauggggaacggaaccgguaggcggcgauga

SEQ ID NO: 20782 - RNA, 1617 nt, Artificial Sequence
  derived and/or modified sequence opt3 from VP1__Norovirus_and/or_Norovirus-like__KX354136
augaagauggccagcuccgacgcuaaccccucugauggcucagcagccaaucuggugccugaggucaguaacgaaguuauggcgcucgagccagugguaggggcugccaucgcagccccgguggcuggacagcaaaauauuauagaccccuggaucagaaacaauuucguccaggcaccugguggcgaauuuaccgugagcccaaggaacgcccccggggagauucuuugguccgcuccucugggaccagauuugaaucccuacuuaucucaccuggcccggauguauaacggcuacgcggguggguucgaaguucaggugauccuagcaggaaaugccuuuacagcuggcaaaauuaucuucgccgcagucccuccaaacuuuccgacugagggccucucgcccucacaggugacgauguucccucauauaaucguagacguucgccaacuggagccagugcuuauuccccugccugauguccgaaauaacuuuuaucacuacaaucagagcaacgacccaaccaucaaguugauugcuaugcucuauacaccccugcgugccaauaacgcgggggaugacguguucacugugaguugcagaguccugaccaggccguccccugauuuugacuucaucuuucucguucccccaacaguggaaucucggaccaaaccuuucagcguacccauauuaacuguggaggaaaugacaaacucccgcuuuccaauuccccuggagaaacuuuucaccggaccuucaagugccuucgucgugcagccacagaaugguagauguacgacugauggcguuuugcuggggaccacacaacuaagcccggugaacaucugcacuuuuaggggagacgucacccauauuacaggcucucacaauuacaccaugaaccucgcaucccagaauuggaacaauuaugaucccacggaggaaaucccugcuccacuggguacucccgacuucguggggaagauccagggaguacuuacacagaccacucggucagacggcagcacacgcggccauaaggccaccguuuacacggggagugcugauuuugccccuaagcugggacgagugcaauucgagaccgacacagauagagacuuugaaacuaaccagaauaccaaauucacaccagucggugugauucaggauggcacuaccgcacacaggaacgagccccaacagugggucuugccgucuuacuccgggcggaauauacacaacgugcaucucgccccugcuguugcgccaacauuucccggagaacagcuguuauucuuucguagcaccaugccuggcuguucggguuaucccaauauggaccuggauugccuccuuccacaggagugggugcaauacuucuaucaggaggcagccccugcucagucugacguagcccuguugcgcuuugucaaccccgauacugggagagugcuauucgaauguaagcugcacaaauccggcuacguuacgguggcacauacaggacagcacgaccucgucaucccaccgaauggcuauuuuagguucgauucaugggugaaccaauucuacacccuggccccuauggggaacggaacuggucggcgacgcuga

SEQ ID NO: 20783 - RNA, 1617 nt, Artificial Sequence
  derived and/or modified sequence opt3 from VP1__Norovirus_and/or_Norovirus-like__KX354121
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagagacuuuucaccggaccuuccucagccuucgucgugcagccacagaacgguagguguacgacugauggcguauugcuggggaccacacaacuaaguccgguuaauauuugcacuuuucggggagacaucacccauauaacaggcagccacaacuacaccaugaaucucgcaucucagaacuggaauaacuaugaucccacggaggaaauuccugcuccacuggguacucccgacuucguggggaagauccagggaguccuuacacagaccacucgcacagacggcuccacccgaggccauaaagccacgguguacaccgggucagcugaguuugccccuaagcugggaagaguccaauucgaaacagauacuaaucacgacuuugaggcaaaccagaauaccaaguucacaccaguggguguuauucaggauggcagcacuacccacaggaacgaaccccaacaguggguguugccgaguuacucugggcggaauacacauaacguacaccucgccccugcugucgcgccaaccuuucccggagagcagcuguuauucuuucguuccacuaugccuggcuguagcgguuaucccaauauggaccuggauugccuccuuccacaggagugggugcaauacuucuaucaggaagcagccccugcucagucggacguugcccuguugcgcuuugugaaccccgauacggggagaguccuauucgaguguaaacugcauaagucuggcuacgugacaguagcacacaccggacagcacgaccucgugaucccaccgaacggcuauuuuagguucgauuccuggguuaaucaauucuacacucuggccccuauggggaacggaaccggucggcgacgcuga

SEQ ID NO: 20784 - RNA, 1617 nt, Artificial Sequence
  derived and/or modified sequence opt3 from VP1__Norovirus_and/or_Norovirus-like__KX354110
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagagacuuuucaccggaccuuccucagccuucgucgugcagccacagaacgguagguguacgacugauggcguauugcuggggaccacacaacuaaguccgguuaauauuugcacuuuucggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacuuccacagacggcucaacccgcggccauaaagccacggucuacaccgggagcgcugaguuugccccuaagcugggacgagugcaauucgaaacagauacugaccacgauuuugagaccaaucagaacacaaaguucacuccaguuggugugauccaggacggcaguaccacacacagaaaugaaccccaacaguggguauugccgucuuacuccgggaggaacacccauaauguccaccucgccccugcaguggcuccaacuuuucccggagagcagcuguuauucuuucggagcacgaugccuggcuguucggguuaucccaacauggaucuggacugccuccuuccacaggaguggguucaauacuucuaucaggaagcggccccugcacagucugauguggcucuguugcguuuugucaaucccgacacagggcgcgugcuauucgaguguaaacugcauaaguccggcuacauuaccguagcccacacuggacagcacgaucucgugaucccaccgaacggcuauuuuagauucgacucauggguuaaccaauucuacacccuggcaccuauggggaauggaacagguaggcggcgauga

SEQ ID NO: 20785 - RNA, 1617 nt, Artificial Sequence
  derived and/or modified sequence opt3 from VP1__Norovirus_and/or_Norovirus-like__KX354107
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccuggcccggauguauaauggcuacgcggguggguucgaaguucaggugauccuagcaggaaacgccuuuacagcuggcaaagucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaugacccaaccaucaaguugauugcuaugcucuauacaccccugcgugccaacaacgcgggggaugacgucuucacuguuagcugcagagugcugaccaggccgaguccugauuuugacuucaucuuucucguacccccaacaguggaaucccggaccaaaccuuucucuguccccguguuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacuggaauaacuaugaucccacggaggaaauuccugcuccacuggguacucccgacuucguggggaagauccagggaguccuuacacagaccacucgcacagacggcuccacccgaggccacaaggccacgguguacaccgggucagcugauuuugccccuaagcugggaagaguccaauucgagacagacacugaucaugacuuugaagcaaaucagaacaccaaauucacaccaguggguguuauucaggauggcagcacuacccacaggaaugagccccaacaguggguguugccgaguuacucugggcggaacacacacaauguacaucucgccccugcugucgcgccaaccuuucccggagaacagcuguuauucuuucguuccacuaugccuggcuguagcgguuaucccaacauggaccuggauugccuccuuccacaggagugggugcaauacuucuaucaggaggcagccccugcucagucggacguugcccuguugcgcuuugugaaucccgauacggggagaguccuauucgaauguaagcugcacaaaucuggcuacgugacaguagcacauaccggacagcacgaccucgugaucccaccgaacggcuauuuuagguucgauuccuggguuaaccaauucuacacucuggccccuauggggaauggaaccggucggcgacgcuga

SEQ ID NO: 20786 - RNA, 1617 nt, Artificial Sequence
  derived and/or modified sequence opt3 from VP1__Norovirus_and/or_Norovirus-like__KX353991
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaacucucgcaucccaauaccccuggagaaacuuuuuacgggaccuagcuccgcguucguugugcagccacagaaugguagauguacuaccgauggcgucuugcuggggacaacucaacuaucaccggugaacauuugcaccuucaggggagacguaacacauaucgccggcagucggaauuacaccaugaaccucgcaagccagaauuggaacucuuaugaucccacggaggaaauuccugcuccacuggguacucccgacuuuguugggaagauccagggagugcuuacacagaccacucgcacagacggcuccacccgaggccacaaggccacggucuacaccgggucagcugauuucagcccuaagcugggaagagugcaauuugccacagacacugauaaugacuucgagaccaaccagaauacaaaauuuacuccagucggugugauccaggauggcgggaccacacauaggaacgaaccccaacaguggguuuugccgaguuacucuggacggaauacccacaacgugcaccucgccccugcaguagcuccaacuuuccccggcgagcagcuguuauuuuuccguuccacgaugccugguuguagcggguaucccaauauggaccuggauugccuccuuccacaggaauggguccaauacuuuuaucaggaggcggccccugcacagucggacguggcucuguugcgcuucguuaaccccgauacaggcagagugcuauuugaguguaagcugcauaaaucuggauacgucaccguggcccacacuggccagcaugaccucguaauuccaccgaacggguauuucagguuugauuccugggugaaucaauucuacacccuggcaccuaugggaaacgguacaggccggcgacgcuga

SEQ ID NO: 20787 - RNA, 1617 nt, Artificial Sequence
  derived and/or modified sequence opt3 from VP1__Norovirus_and/or_Norovirus-like__KU985162
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuugccccuaagcugggacgagugcaauucgagacagacacuaaucacgauuuugaagcaaaccagaauaccaaauucacaccaguuggugugauccaggacggcagcacuacccacagaaacgagccccaacaguggguauugccgaguuacucugggaggaauacaccuaacguccaucucgccccagcuguggcgcccaccuuuccuggagaacagcuguuauucuuucgguccacuaugcccggcuguagcgguuauccaaauauggaucuggacugccuccuuccucaggaguggguucaauacuucuaucaggaggcagcccccgcucagucggauguggcccuguugcguuuugucaacccagacacggggcgcgugcuauucgaauguaagcugcacaaaucuggcuacguaacaguggcacauaccggacagcacgaucucguuauuccgccuaacggcuauuuuagauucgacuccugggucaaucaauucuacacucuggcccccauggggaacggaaccgguaggcggcgauga

SEQ ID NO: 20788 - RNA, 1617 nt, Artificial Sequence
  derived and/or modified sequence opt3 from VP1__Norovirus_and/or_Norovirus-like__AB972476
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucgaaacagacacugagaacgauuuugaaacccaucaaaauacaaaguucacuccagucggcgugauccaggacgggggaaccacacaccgaaacgagccccagcaauggguccucccgagcuacaguggcagaaaugugccuaacguucaccuggcaccagccguggcucccaccuuuccuggugagcaguuacuguucuuuaggucuacuaugcccggguguuccggcuauccaaauauggaucucgacugccuucugccucaggaauggguacagcauuucuaccaagaggcggcacccgcccagagcgaugucgcuuugcuacgguuugugaacccagacacgggacguguucuguucgaauguaaacuccacaagucgggcuaugugacagucgcccauaccgggcagcacgaucuggugauuccgccuaacggauacuuucgcuucgacucuuggguaaaucaguucuauacucuugcacccauggguaacggcaccgggagaaggcgguga

SEQ ID NO: 20789 - RNA, 1617 nt, Artificial Sequence
  derived and/or modified sequence opt3 from VP1__Norovirus_and/or_Norovirus-like__KU311162
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaggacagcaccauuaaauugaucgcuaugcucuauacaccacugcgugccaauaacgcgggggaugacguguucacugucaguugcagaguucugaccaggcccuccccggauuuugacuucauuuuucucgugccucccacaguagaaucucggaccaagccauucacugugccuaucuuaacagucgaggaaaugaccaacagccgcuuucccauaccacuggagaaacuuuucacgggacccuccaaugccuucgugguucagccucagaacgguagauguacuaccgauggcguguugcuggggacaacucaacuaucaccagucaauauuugcaccuuuaggggagacgugacacagaucgcaaguacccagacguacacuaugaaccucgcuagccugaauuggaacaauuaugauccgacagaggaaauucccgccccucuuggcgcuccagacuucauggguaagauccaggggguacugacccaaacuacacggcagggaggcucuacccgcggccauaaggccacgguuuccaccgggucagugcacuuuacacccaaauugggaagcguccgauucgacacugauaccaacaaugaccuccagccucaucaaaguacaagauuuacuccagugggugucauccaggauggcgacacccaccagaacgagccccagcaaugggcacugccguguuacucugggagggaugugaauaacguucacuuagccccugcuguggcgccauccuuccccggagaacagcugcucuuuuuccggagcacaaugccuggcugcucggguuaccccaauauggaccuugauugucuguugccacaggaguggguacagcauuuuuaucaagaagcagccccugcucagucugacgucgcccuacugcguuucgugaaccccgauaccgggcgcguucucuuugagugcaagcugcacaaauccggcuacgugacugucgcacauacgggacagcacaaucuugugauuccaccgaacggcuauuucagauuugacucauggguaaaccaguucuacacacuggccccuauggggaauggaaccgguaggcggcgaguguga

SEQ ID NO: 20790 - RNA, 1617 nt, Artificial Sequence
  derived and/or modified sequence opt3 from VP1__Norovirus_and/or_Norovirus-like__KR904212
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucacguucgcugccgugccuccaaauuuuccgaccgagggccucucucccucgcagguaacaauguucccucauauuaucguugacgugcgccaacuggagccaguccuuauaccccugccugaugugcgaaacaauuuuuaucacuacaaccagucaaaugacccaacuaucaaguugauugcaaugcucuauaccccucugcgugcuaacaacgccggggaugacguguucacagucagcugcagaguucugaccaggccgaguccugauuuugacuucaucuuucucgugcccccaacuguagaaucccggacaaaaccuuucucugugcccauuuuaaccgucgaggaaaugacgaauagccgcuuuccaaucccccuggagaaacuuuucacuggaccuuccucaaccuucgugguucagccacagaacgguagauguacaacugauggcguguugcuggggaccacacaacuaaguccggucaauauaugcaccuuuaggggagacgugacgcauauuacuggcagccacaacuacacaaugaaucucgcgucucagaacugguccucauaugaucccaccgaggaaaucccugccccacuggguacucccgacuucguagggaagauucagggaguucuuacacagaccacgcggaccgacggcagcacacgcggccauaaggcaacuguguuuaccgggagugcugauuucucuccuaagcugggacgaguccaauuugccacagacacugauaaugacuucguggcuaaccagaauaccaaauuuacaccagucggugugauccaggauggcgggaccgcccacagaaacgagccccaacaguggguuuugccguccuacagcggaaggaauauccacaacgugcaucucgcacccgccguagcuccaacuuuccccggcgaacagcuguuauuuuuccggucgacgaugccugguuguucuggguaccccaauauggaccuggauugccuccuuccacaggaguggguccaauauuuuuaccaggaagcggccccugcacaguccgacguggcucuguugcguuucguuaaccccgauacaggccgcgugcuauuugaguguaagcugcacaaaucaggauaugucaccguggcccauacuggccagcacgaccucguaauuccaccgaauggguacuucagauucgauaguugggugaaccaauuuuauacccuggcaccuaugggaaacgguacaggcaggcggcgauga

SEQ ID NO: 20791 - RNA, 1617 nt, Artificial Sequence
  derived and/or modified sequence opt3 from VP1__Norovirus_and/or_Norovirus-like__AB933678
augaagauggccagcaacgacgcuaaucccuucgauggcuccgcagccaaccuggugccugaggucaauaacgaaguuauggcgcucgagccagugguaggggcugccaucgcagccccgguggcuggacagcaaaaugucauugaccccuggauaagaaacaauuuugugcaggcaccugguggcgaguucaccguuucuccaaggaacgcccccggggaaauccuuuggucagcuccucugggaccagauuugaaucccuacuuaagucaccuggcccggauguauaacggcuacgcggguggguuugaagugcaggucauucuagcaggaaaugccuucacagcuggcaaaaucauuuuugccgcagugccuccaaacuucccggcugagggccucagccccucccagguaacuauguuuccucauaucauaguugacgugcgccaacuggagccaguccuuaucccccugccugaugugcgaaauaacuucuaucacuacaaucagucuaacgacucgacgauuaaguugaucgccaugcucuauaccccacugcgugcgaacaaugccggggaagauguguuuacagucucaugcagaguucugacuaggcccagcccggacuucgauuuuauuuuccucgugccucccaccguagagagucggacaaaaccauuuaccgugccuaucuuaacugucgaagagaugacaaacucccgcuuccccauaccacuggagaaacuuuucaccggacccucuagcgcauuugugguucagccucagaaugguagauguacgacugacggcguguugcuggggaccacacaacuauccccagucaacauuugcacuuucaggggagaugugacccauaucgcuggcucacggaauuacacaaugaaccucgccagucugaauuggaacaauuaugacccgaccgaagagauucccgcuccucuugguacgccagauuuuguagggaagauccagggaguucugacucagacaaccaagggcgacggcagcacucgcgggcacaaggccacaguguacaccggaucugcacccuucacgccuaaauuggguuccguccaguuuucaaccgacacagaaaacgauuucgagacucaucaaaauaccaaguuuacaccagugggcgucauccaggacgggggaacuacccaccgaaacgaaccccagcaaugggugcucccgagcuacaguggcagaaauguuccuaacgugcaccuggccccagcuguagcgcccacauucccuggugagcaguuacuguuuuucaggucuaccaugcccggguguuccggcuauccaaauauggaucucgacugccuucugccucaggaguggguccagcauuuuuaccaagaagcagcccccgcucagagcgauguggccuugcuacgguucguuaacccagacacuggacgugugcuguuugaguguaaacuccacaagucgggcuaugucacgguggcacauacagggcagcacgaucugguaauuccgccuaacggauacuuccgcuucgacucuugggugaaucaguuuuauacccuugcccccauggguaacggcacugggagaaggcgguga

SEQ ID NO: 20792 - RNA, 1617 nt, Artificial Sequence
  derived and/or modified sequence opt3 from VP1__Norovirus_and/or_Norovirus-like__AB933648
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugagacccaucaaaacacaaaguucacuccagugggggucauccaggacggaaguaccacacaccgaaaugaaccccagcaaugggugcucccgucuuacuccggcagagauguucacaacgugcaucuggccccugcaguagcuccaaccuuucccggugagcaguuacuguucuuuaggagcacuaugccuggguguucgggcuaucccaauauggaccucgauugccuucugccacaggaguggguccagcacuucuaccaagaagcggccccugcacagucugacguggcuuugcuacgguuuguuaaccccgauacgggacgugugcuguucgaguguaaacuccauaaguccggcuaugucacaguggcccacaccgggcagcacgaccugguaauuccaccgaauggauacuuucgcuucgauucaugggugaaccaguucuauacucuugcaccuauggguaacggcaccgggagaaggcgguga

SEQ ID NO: 20793 - RNA, 1617 nt, Artificial Sequence
  derived and/or modified sequence opt3 from VP1__Norovirus_and/or_Norovirus-like__LN854571
augaagauggccagcaacgacgcugcacccuccgauggcucuaccgccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagucgaaugacccaacaauuaaguugaucgcuaugcucuauacuccccugcgugccaacaacgcgggggaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaauucucgcuuuccaaucccccuggagaaacuuuucacgggaccuagcuccgccuucguugugcagccacagaacgguagauguacuaccgauggcgucuugcuggggacaacucaacuaucaccggugaauauaugcaccuuuaggggagacguaauucauauccccggcagucggaacuacacaaugaaucucgcaagccagaacuggaacucuuaugauccuaccgaggaaauuccagcuccccuggguacgccugacuucguugggaagauccagggagugcuuacucagacaacccgcacuaauggcuccacacgaggccacaaggccaccgucuacacggggucagcugacuuuagcccaaagcugggaagagugcaauucgccaccgauacagacaaugauuuugagacuaaccagaauaccaaauucacacccgucggugugauccaggacggcaguacuaccccgaggaacgaaccucaacaguggguuuugccaucuuacuccgggcggaauauucauaacgugcaccucgcacccgccguagcuccuacauuucccggagagcagcuguuauucuuucguagcaccaugccaggcuguucggguuauccuaauauggaucuggacugccuccuuccccaggaauggguccaauacuucuaucaggaggcggcaccagcccagucugauguggcucuguugcgcuuuguuaacccggacacugggagagugcuauucgaguguaagcugcacaaauccggcuacgucacgguggcccauacaggacagcacgaucucguaauaccucccaacggcuauuuuagguucgacucaugggugaaucaauucuacacccuggcaccaauggggaacggaacuggucggcgacgcuga

SEQ ID NO: 20794 - RNA, 1617 nt, Artificial Sequence
  derived and/or modified sequence opt3 from VP1__Norovirus_and/or_Norovirus-like__EU921384
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugagacccaucaaaacacaaaguucacuccagugggggucauccaggacggaaguaccacacaccgaaaugaaccccagcaaugggugcucccgucuuacuccggcagaaacguucacaaugugcaucuggccccugcaguagcuccaaccuuucccggugagcaguuacuguucuuuaggagcacuaugccuggguguucgggcuaucccaacauggaucucgacugccuucugccacaggaguggguccagcacuucuaccaagaagcggccccugcacagucugauguggcuuugcuacgguuuguuaaucccgacacgggacgugugcuguucgaguguaaacuccauaaguccggcuaugucacaguggcccacaccgggcagcacgaucugguaauuccaccgaacggauacuuucgcuucgacucaugggugaaccaguucuauacucuugcaccuauggguaauggcaccgggagaaggcgguga

SEQ ID NO: 20795 - RNA, 1617 nt, Artificial Sequence
  derived and/or modified sequence opt3 from VP1__Norovirus_and/or_Norovirus-like__LC005716
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagcgguaacuacaccaugaaucucgcuucuguaaacuggaauaacuaugacccgacggaagagauucccgccccucuggggacuccagauuucguuggaaagauccagggcaugcuuacacagaccacuaagggcgacggguccacacggggacacaaggcuaccguguacacggguucagcccccuuuaccccuaaacugggcagcguccaguucaguacagacacugaaaaugauuuugagacccaucaaaacacaaaguucacuccagugggggucauccaggacggaaauaccacacaccgcaacgaaccccagcaauggguguugccgucuuacuccggccgaaauguuccuaacgugcaccucgcaccagccguagcucccaccuuuccuggugagcagcuguuauucuuuagaagcacuaugcccggguguucgggcuauccaaauauggaucuggacugccuccuuccucaggaguggguccagcauuucuaccaagaagcggcacccgcccagucugauguggcucuguugagguuuguuaacccagacacgggacgggugcuauucgaguguaaacugcacaaguccggcuaugucacaguggcccauaccgggcagcacgaucucguaauuccgccuaacggauacuuucguuucgacucaugggugaaucaguucuauacucuggcacccauggguaacggcaccgggcgcagaagguga

SEQ ID NO: 20796 - RNA, 1617 nt, Artificial Sequence
  derived and/or modified sequence opt3 from VP1__Norovirus_and/or_Norovirus-like__KP241914
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggaacaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuuaguccuaagcugggaagagugcaauucgagacagacacugauagggacuuugaagccaaccagaauaccaaauucacaccaguuggugugauccaggauggcgggacuacccaucggaacgagccccaacaguggguauugccgucuuacuccggacguaaugcaccuaacguccaccucgccccagcuguggcgcccacauuuccuggcgaacagcuguuauucuuucgcagcaccaugcccgguuguucgggguauccaaauauggaccuggauugccuccuuccucaggaguggguucaauacuucuaucaggaggcagcccccgcucagucugacguggcccuguugagauuugucaacccagauacuggcagggugcuauucgaauguaagcugcacaaauccggauacguaacgguggcacauacaggccagcacgaccucguuauuccgccuaauggguauuuucgguucgauucaugggucaaccaauucuacacccuggcccccaugggaaacgguacuggccgacgcagauga

SEQ ID NO: 20797 - RNA, 1617 nt, Artificial Sequence
  derived and/or modified sequence opt3 from VP1__Norovirus_and/or_Norovirus-like__KJ433968
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugccggggaccacacaacugagucccguuaauauuugcacuuuuaggggagacgugacccauaucacaggcagccggaacuacaccaugaaucuagcaucucagaacuggaauaacuaugauccuacggaggaaauaccagcuccccucgguacuccugacuucgucgggaagauucagggagugcugacacagaccacucgcuccgacggcucaacacgaggccacaaggccaccgucuacacggggagcgcugauuuugccccaaaacuuggaagagugcaauucgagaccgacacagauagggacuuugaagcaaaucagaacacuaaguucacccccguuggugugauccaggauggcgggacaacucaucggaaugagccgcaacaguggguacugccuaguuacucuggacguaacaccccaaauguccacuuggcccccgcuguggcgccuacauuucccggcgaacagcuccuguucuuucgcuccaccaugccagguuguagcggguauccuaacauggacuuagauugccugcucccccaggaguggguucaauacuucuaucaggaggcagccccagcucagucggacguggcccuucugagauuugucaauccggauacuggcaggguguuguucgaauguaagcuacacaaaucuggauacguaacgguggcacauacaggccagcacgaccugguuauuccucccaacggguauuuucgguucgauuccugggucaaccaauucuacacccucgccccaaugggaaaugguacuggccgacgcagauga

SEQ ID NO: 20798 - RNA, 1617 nt, Artificial Sequence
  derived and/or modified sequence opt3 from VP1__Norovirus_and/or_Norovirus-like__KP176409
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugauagggacuuugaagcaaaucagaacaccaaauucacaccaguuggugugauccaggauggcgggacuacccaucggaaugagccccaacaguggguauugccgucuuacuccggacguaacacaccuaauguccaccucgccccagcuguggcgcccaccuuuccuggcgaacagcuguuauucuuucgcagcacuaugcccgguuguucgggguauccaaacauggaccuggauugccuccuuccucaggaguggguucaauacuucuaucaggaggcagcccccgcucagucugacguggcccuguugagauuugucaauccagauacgggcagggugcuauucgaauguaagcugcacaaauccggauacguaacaguggcacauaccggccagcacgaccucguuauuccgccuaacggguauuuucgguucgauucaugggucaaucaauucuacacucuggcccccaugggaaacgguaccggccgacgcagauga

SEQ ID NO: 20799 - RNA, 1617 nt, Artificial Sequence
  derived and/or modified sequence opt3 from VP1__Norovirus_and/or_Norovirus-like__KM514064
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaagcgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucacaauuacaccaugaaccucgcaucccagaauuggucaaacuaugaucccacggaggaaauaccugcuccacuggguacucccgacuucgucgggaagauucagggagugcuuacacagaccacucggacagacggcagcacccgcggccauaaggccacggucuacaccgggagugcugauuuugccccuaagcugggacgagugcaauucgagacagacacuaaucacgauuuugaagcaaaccagaauaccaaauucacaccaguuggugugauccaggacggcucuacuacccacagaaacgagccccaacaguggguauugccguccuacagcgggaggaauacaccuaacguccaucucgccccagcuguggcgcccaccuuuccuggagaacagcuguuauucuuucggucgacuaugcccggcuguucugguuauccaaauauggaucuggacugccuccuuccucaggaguggguucaauacuucuaucaggaggcagcccccgcucaguccgauguggcccuguugcguuuugucaacccagacacggggcgcgugcuauucgaauguaagcugcacaaaucaggcuacguaacaguggcacauaccggacagcacgaucucguuauuccgccuaauggcuauuuuagauucgacaguugggucaaccaauucuacacucuggcccccauggggaacggaaccgguaggcggcgauga

SEQ ID NO: 20800 - RNA, 1617 nt, Artificial Sequence
  derived and/or modified sequence opt3 from VP1__Norovirus_and/or_Norovirus-like__KJ649703
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuuagcccuaagcugggacgaauccaauucgagacagacacuaaucacgauuuugaagccaaccagaauaccaaauucacaccaguggguguuauucaggacggcgggacuacccacagaaacgagccccaacaguggguguugccgaguuacucuggaaggaauacaccuaacguacaucucgcaccagccgucgcucccaccuuuccuggcgaacagcuguuauucuuucgguccacuaugcccgguuguagcggguauccaaauauggaucuggacugccuccuuccucaggagugggugcaauacuucuaucaggaggcggcacccgcccagucggauguugcucuguugcguuuugugaacccagacacgggccgcguccuauucgaauguaagcugcacaaaucuggauacgugacaguagcccauaccggccagcacgaucucgugaucccgccuaacggguauuuuagauucgacuccuggguuaaucaauucuacacucuggcacccaugggaaacgguaccggcaggcggcgauga

SEQ ID NO: 20801 - RNA, 1617 nt, Artificial Sequence
  derived and/or modified sequence opt3 from VP1__Norovirus_and/or_Norovirus-like__KF177447
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacauaaugaaucucgcaucucagaacugguccaauuaugaucccaccgaggaaauuccugcuccacuggguacgcccgacuucgucgggaagauccagggagugcuuacucagacaacccgcacugacggcucaacacgaggccacaaggccaccgucuacacggggagcgcugauuuugccccuaagcugggaagagugcaauucgagaccgacacagaucaugacuuugaagcaaaccagaauacuaaauucaccccaguuggugugauucaggauggcaguacaacucacaggaacgagccccaacaguggguauugccgucuuacuccgggcggaauaccccuaacguccaccucgccccagcuguggcgcccacauuuccuggagaacagcuguuauucuuucguagcaccaugcccggcuguucggguuauccaaauauggaccuggauugccuccuuccucaggaguggguucaauacuucuaucaggaggcagcccccgcucagucugacguggcccuguugcgcuuugucaacccagauacugggagagugcuauucgaauguaagcugcauaaauccggcuacguaacgguggcacacacaggacagcaugaccucguuaucccgccuaauggcuauuuuagguucgauucaugggucaaccaauucuacacccuggcccccauggggaacggaacuggucggcgacgcuga

SEQ ID NO: 20802 - RNA, 1617 nt, Artificial Sequence
  derived and/or modified sequence opt3 from VP1__Norovirus_and/or_Norovirus-like__JX439820
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaacucucgcuuuccaaucccccuggagaaacuuuucacgggaccuagcuccgcguucguugugcagccacagaaugguagauguacuaccgauggcgucuugcuggggacaacucaacuaucaccggugaacauaugcaccuuuaggggagacguaacacauauuaguagcucucggaauuacaccaugaaccucgccucccagaauuggucaagcuaugaucccacggaggaaaucccugcaccacugggcacucccgacuucguugguaagauucagggggugcuuacacagaccacucgcacagacggaaguacccgaggccacaaggcuacggucuacaccggcucugccgauuuuuccccuaagcuggggagagugcaauucgacacagauacugacaacgauuuugagaccaaucagaacacaaaauucacuccagucggagugauccaggacgguagcaccacauacaggaaugaaccccaacaguggguuuugccgucguauucuggccggaacacccauaaugugcaccucgcuccugccguagcaccaacuuuucccggggagcagcuguuauucuuucguuccacgaugccuggauguucaggcuaccccaacauggaucuggacugccuccuuccacaggaauggguccaauauuucuaccaggaggccgcuccugcgcagagugauguggcacuguugcgcuuuguuaaucccgacacagguagagugcuauucgaguguaagcugcacaaaagcggguaugucaccguggcccauacuggccagcacgaucucguaaucccaccgaacggauacuuuagguucgacuccugggugaaccaauucuauacccuggcuccuaugggcaaugggacaggacggcgacgcuga

SEQ ID NO: 20803 - RNA, 1617 nt, Artificial Sequence
  derived and/or modified sequence opt3 from VP1__Norovirus_and/or_Norovirus-like__HF952120
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacauuauagaccccuggaucagaaauaacuucguccaggcuccugguggcgaauuuacagugaguccaaggaaugcacccggggagauucuuuggagcgccccucugggaccagauuugaaccccuacuuaucccaccuggcucggauguauaauggcuacgccgguggguucgaaguucaggugauccuagcgggaaacgcauuuacugccggcaaaauuaucuucgcugccgucccuccaaauuuuccgacggagggccucucucccucacaggugaccauguucccucauauaaucguagacguucgccaacuggagccagugcuugucccccugccugaugugcgaaacaauuuuuaucacuacaaccagucgaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccggaacuacaccaugaaucucgcaucucagaacuggaacuccuaugaucccacggaggaaauuccugcuccacuggguacucccgacuucguagggaagauccagggaguucuuacacagaccacucgcacagacggcucaacccgaggccacaaggccacgguguacaccgggagcgcugauuuuaguccuaagcugggaagaguccaauucgccacagacacugauaaugacuuugaggcaaaucagaacaccaaauucacaccagugggugucauccaggauggcucuacugcccauaggaaugaaccccaacaguggguguugccguccuacagcgggcggaacauucacaauguucaccucgcuccugcgguggcaccaaccuuucccggagagcagcuguuauucuuucguucgacaaugccuggcuguucugguuaucccaacauggaccuggauugccuccuuccacaggaauggguacaauacuucuaucaggaggccgcuccugcccaguccgacgucgcacuguugcgcuuugugaaucccgauaccgggagaguucuauucgaguguaagcugcauaaaccaggcuacgugacugucgcccacacgggacagcaugaccucgugauaccgccuaacggcuauuuuagguucgauucauggguaaaccaauucuacacacuggcucccauggggaauggaaccggucggcgacgcuga

SEQ ID NO: 20804 - RNA, 1617 nt, Artificial Sequence
  derived and/or modified sequence opt3 from VP1__Norovirus_and/or_Norovirus-like__KC517369
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccacugugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcuccgcguucgugguucagccucagaaugguagauguaccacagacggcguguugcuggggacuacccaacuaucaccagucaacauuugcacauuuaggggagaugugacccauaucgccggcagucggaauuacacgaugaaccucgcaagccugaauuggaacaauuaugacccgacugaagagauucccgcuccucuugguacaccagauuucguagggaagauccagggaguucugacccagacuacaaagggcgacggcucuacccgcgggcacaaggccacgguguacaccggauccgcucccuuuacaccuaaauuggguucaguccaguucgaaacugacaccgagaacgauuuugaaacacaucaaaauacuaaguucaccccagugggcgucauccaggacgggggaacaacccaccgaaacgagccccagcaaugggugcucccgagcuacaguggcagaaauguuccuaacgugcaccuggccccagcaguagcccccacuuuuccuggugagcaguuacuguucuuuaggucuacgaugcccggguguuccggcuauccaaauauggaucucgacugccuucugccucaggaauggguccagcauuucuaccaagaggcugcgcccgcacagagcgauguggccuugcuacgguuuguuaacccagacacaggacgugugcuguucgaauguaaacuccacaagucgggcuaugucaccguggcucauacugggcagcacgaucugguaauuccgccuaacggauacuuucgcuucgacucuugggugaaucaguucuauacccuugcccccauggguaacggcacagggagaaggcgguga

SEQ ID NO: 20805 - RNA, 1617 nt, Artificial Sequence
  derived and/or modified sequence opt3 from VP1__Norovirus_and/or_Norovirus-like__KC409293
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagagauguucagaacgugcaccuggccccugcaguagcuccaacuuuucccggggagcaguuacuguucuuuaggucuacgaugccuggcuguuccggauaucccaauauggaccucgauugccuucugccacaggaguggguccaacauuucuaccaggaagcggccccugcacagagcgacguggcuuugcuacgguuuguuaaccccgauacaggccgugugcuguucgaguguaaacuccacaagucgggguaugucaccguggcccauacuggacagcacgaccugguaauuccaccgaaugguuacuuucgcuucgauucuugggugaaccaauucuauacccuugcaccuaugggcaacgggacaggaagaaggcgguga

SEQ ID NO: 20806 - RNA, 1617 nt, Artificial Sequence
  derived and/or modified sequence opt3 from VP1__Norovirus_and/or_Norovirus-like__JX984951
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccgauucagcacagacacugaaaacgauuuugagacccaucagaauacaaaguucacuccagugggcgucauccaagacgggggaaccacacacagaaacgaaccccagcagugggugcucccgaauuacaguggcucugauguuccuaacgugcaccuggcaccagccguagcucccaauuuuccuggugagcaauuacuguucuuuagguccaccaugcccggguguagcggcuauccaaacauggaccucgauugccuucugccucaggaguggguccagcauuucuaccaggaagcggcacccgcccaaucggacguggcuuugcuacgguuuguuaacccagauacuggacgugugcuguucgaguguaaacuccacaagucuggcuaugucacgguggcccauacagggcagcacgaccugguaauuccgccuaauggauacuuucgcuucgauuccugggugaaccaguucuauacccuugcacccauggguaauggcacugggagaaggcgguga

SEQ ID NO: 20807 - RNA, 1617 nt, Artificial Sequence
  derived and/or modified sequence opt3 from VP1__Norovirus_and/or_Norovirus-like__JX459612
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacucuuacgccggcgguuucgaagugcaggucauucuagcggggaaugcauuuacugccggaaaaaucauuuucgcugccgugccuccaaacuuuccgacggagggccucucgcccucacagguaaccauguucccucacaucauaguugacgugcgccaacuggagccaguccuuaucccccugccugaugugcgaaauaacuuuuaucauuacaaucagagcaacgacccaacaauuaaguugaucgcaaugcucuauacuccccugcgugcuaauaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaacucccgcuuuccaauaccccuggagaaacuuuucacggggccuucaagugcguucgugguucagccacagaauggaagauguacuaccgaugguguguugcugggcacaacucaacuaagcccggucaacauuugcaccuuuaggggagacgugacacacaucgccgggacccaggaguacacgaugaaucucgcaucucagaacuggaauaacuaugaucccacugaagagauuccugcuccacugggcacacccgacuucguagguaagauccaggggguucuuacccaaacuacaucccgggacggaucaacccgcggccauaaggccacggugagcaccggcaguguccacuuuacaccuaagcuggggcgagugcaguucucuacugauaccuccaaugacuuugaaacaggacagaacacuagauucaccccagucggugugguucaagauggcagcacaacccaccagaaugagccccagcaguggguguugccgaacuacucggggagggacucucauaauguacaccucgcuccugccgucgcaccauccuuucccggagaacaacuguuauucuuucggucaacuaugccuggcuguagugguuaccccaacaugaaucuggauugccuccuuccacaggagugggugcagcauuucuaucaggaggccgcuccugcgcaaagcgacguugcacuguugcguuuugugaaccccgauacggggcgcguccuauucgaauguaaacugcacaaguccggcuacgugacaguagcccacaccggacagcaugaccucgugaucccaccgaauggcuauuuuagauucgauucuuggguuaaccaguucuacacucuggcuccuauggggaacggaaccgguaggcggcgauga

SEQ ID NO: 20808 - RNA, 1617 nt, Artificial Sequence
  derived and/or modified sequence opt3 from VP1__Norovirus_and/or_Norovirus-like__JX459604
augaagauggccagcaacgacgugacccccuccgauggcucugcugcaaaucuggucccugagguuaacaaugaagugauggcccucgagccaguagugggggcggcuaucgccgcaccggucgccggacagcaaaacgugauugaccccuggauaagaaauaacuucguucaggcuccugguggcgaauuuacagugucaccaaggaaugcacccggggagauccuuuggagugccccucugggaccagauuugaaccccuacuuaagccaccuggcucggauguauaauggcuacgccgguggguucgaaguccaggugauucuagcgggaaacgcauuuacugccggcaaaaucauuuucgcugccguaccuccaaauuuuccgacggagggccucucccccucucagguuaccauguucccucauaucauaguggacguccgccaacuggagccagugcuuaucccccugccugaugugcgaaacaauuuuuaucacuacaaccagucgaaugacucaacaauuaaguugaucgcaaugcucuauacuccacugcgugcuaacaacgccggggaagaugucuucaccguuagcugcagagugcugacaaggcccaguccggacuuugauuucauuuuucucguaccucccaccguggagucccggacuaaaccauucacagucccuaucuuaaccguggaagagaugacuaauucucgcuuucccauaccacuggagaaacuuuucacgggacccagcggugcguucguugugcagccucagaacggcagauguaccacagacggggucuugcugggaacuacccaacuauccccagugaauauuugcacauuuaggggcgauguaacccauaucgccgguucacggaacuacacgaugaaucucgcaagucugaacuggaauaacuaugacccgacugaagagauucccgcuccucuugggacaccagauuucguuggaaagauccagggcgugcugacccagacuacaaagggcgacgggagcacccgcggacacaaggccacggucuacaccgguucugcucccuuuacaccuaaauugggcuccgugcaguucucaacugacaccgaaaaugauuuugagacacaucaaaacacuaaguucaccccagucggggugauccaggacggaggcacaacccaccgaaaugaaccccagcaauggguucucccgagcuacagugguagaaacgugcacaauguacaucuggccccugcagucgccccaacuuuucccggggagcaguuacuguucuuuaggucuacgaugccuggcuguuccggauaucccaacauggaucucgacugccuucugccacaggagugggugcagcacuucuaccaagaagcugcgccugcacagagcgauguugccuugcuacgguuugugaaucccgacacaggccguguccuguucgaguguaaacuccauaagucgggguaugugaccguagcucacacuggacagcacgaucuggugauuccaccgaacgguuacuuucgcuucgacucuuggguuaaccaguucuauacccuugccccuaugggcaaugggacaggaagaaggcgguga

SEQ ID NO: 20809 - RNA, 1617 nt, Artificial Sequence
  derived and/or modified sequence opt3 from VP1__Norovirus_and/or_Norovirus-like__JX155745
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacucgcggcgacggcucuacacgagggcacaaggcuaccguguacacgggauccgcccccuuuaccccuaagauggguucaguccaguucagcacagacacugaaaacgauuuugagacccaucaaaauacaaaauucacuccagugggcgucauccaggacgggggaaccacacacagaaacgaaccccagcaauggguguugccgaguuacucuggcaggaauguuccuaacgugcaccucgcaccagccguagcucccaccuuuccuggugagcagcuguuauucuuucgguccacuaugcccggguguagcggcuauccaaauauggaucuggacugccuccuuccucaggaguggguccagcauuucuaccaagaagcggcacccgcccagucggauguggcucuguugcguuuuguuaacccagacacgggacgcgugcuauucgaguguaagcugcacaaaucuggcuaugucacaguggcccauaccgggcagcacgaucucguaauuccgccuaacggauacuuuagauucgacuccugggugaaucaguucuauacucuggcacccauggguaacggcaccgggaggcggcgauga

SEQ ID NO: 20810 - RNA, 1617 nt, Artificial Sequence
  derived and/or modified sequence opt3 from VP1__Norovirus_and/or_Norovirus-like__HM635155
augaagauggccagcuccgacaccaaaacaucugauggcucaacugcuaaccuggugcccgaggucaauaacgaaguuauggcacucgagccugugguaggggccgcgaucgcugccccaguggcaggacagcaaaaugucauugacccguggauaagaaacaauuucgugcaggcccccgguggcgaauuuacgguuaguccuaggaacgcuccaggggagauccuuuggagcgcaccccugggaccugauuugaauccauacuuaucccaccuggcccggauguauaacggcuacgcugguggguucgaagugcaggucauucuagccggaaaugcguuuaccgcaggcaagaucauuuucgccgcugugcccccuaacuuuccaacagagggccucucuccgucgcagguaacuauguucccccauaucauaguugacgugcgccaacuggagccuguccuuaucccacugcccgaugugcgaaauaacuuuuaucacuacaaucagucaaacgacccuaccauuaaauugaucgccaugcucuauacaccacugcgugcaaauaacgcuggggaugacguguucaccgucagcugcagaguucugacuaggcccaguccggauuuugacuucauuuuucucgugccucccacaguagaaucccggaccaagccauucucugugccuaucuuaacggucgaggaaaugacuaacagccgcuuucccauaccacuggagaaacuuuucaccggacccuccucagccuucgugguucagccucagaaugguagauguacaauugauggcguguugcuggggacuacccaacuaaguccagucaacaucugcacauuuaggggagacgugacccauauuacgggcagccggaauuacacuaugaaccucgcgacacagaauuggaacucuuaugauccgaccgaggaaauccccgccccucuggguacuccagacuucguagggaagauccagggaguucuuacacagaccacgcgcgcagacggcuccacccgaggccacaaggcuacaguguacacugggucagccgauuuugcucccaaacugggaagaguccaauucgccaccgacacagauaaugacuuugaugcaaaccagaauacuaaguucaccccugugggugucauucaggacggcaacacagcccauaggaaugagccacaacaguggguguugcccagcuacagugggcggaacucucacaauguucaccucgcuccggcgguggcaccuaccuuuccaggagaacagcuguuauucuuucguuccacuaugcccggcuguagcgguuauccuaacauggaucuggacugccuccuuccccaggaguggguacaauacuucuaucaggaagccgcuccagcccagucggaugucgcacuguugcgcuuugugaauccugacacggggagaguucuauucgaguguaaacugcauaagucuggcuacgugacagucgcccacaccggacagcaugaucucgugauacccccaaacggcuauuuuagguucgacuccuggguaaaccaauucuacacucuggcuccgauggggaauggaaccggucggcgacgcuga

SEQ ID NO: 20811 - RNA, 1617 nt, Artificial Sequence
  derived and/or modified sequence opt3 from VP1__Norovirus_and/or_Norovirus-like__JN400620
augaagauggccagcaacgacgugaaucccuccgauggcucugcugcaaaccuggucccugagguuaauaacgaagugauggcccucgagccaguagugggggcggcuaucgccgcaccggucgccggacagcaaaaugugauugaccccuggauaagaaacaauuucguucaggcuccugguggcgaauuuaccgugucaccaaggaacgcacccggggagauccuuuggagugccccucugggaccagauuugaaucccuacuuaagccaccuggcucggauguauaacggcuacgccgguggguucgaaguccaggugauucuagcgggaaaugcauuuacagccggcaaaaucauuuucgcugccguaccuccaaacuuuccgacugagggccucucccccucucagguuacgauguucccucauaucauaguggacguccgccaacuggagccagugcuuaucccccugccugaugugcgaaauaacuuuuaucacuacaaucagucgaacgacucaaccauuaaguugaucgcaaugcucuauacaccacugcgugcuaacaaugccggggaagaugucuucacuguuagcugcagagugcugaccaggcccaguccggacuuugauuucauuuuucucguaccucccacaguggagucccggaccaaaccauucacugucccuaucuuaacaguggaagagaugaccaacucucgcuuucccauaccacuggagaaacuuuucacgggacccagcuccgcguucguugugcagccucagaaugguagauguacuaccgacggcgucuugcuggggacaacucaacuaucaccagugaacauuugcaccuuuaggggagauguaacacauaucgccggcagucggaauuacaccaugaaccucgcaagccugaauuggaacaauuaugacccgacggaagagauucccgcuccucuugguacuccagauuucguugggaagauccagggagugcugacacagaccacuaagggcgacggcucuacacgcgggcacaaggccaccgucuacacgggauccgcucccuuuaccccuaaauuggguucagugcaguucagcacagacacugaaaacgauuuugagacccaucaaaauacaaaguucacuccagucggcgugauccaggacgggggaaccacacaccgaaacgaaccccagcaauggguucucccgaguuacucuggcagagaugugccuaauguacaccuggccccagcagucgcccccaccuuuccuggugagcaguuacuguucuuuagguccacuaugcccggguguagcggcuauccaaacauggaccucgauugccuucugccucaggagugggugcagcauuucuaccaagaagcugcgcccgcacagucggacguugccuugcuacgguuugugaauccagauacgggacguguccuguucgaguguaaacuccacaagucuggcuaugugacaguagcucauaccgggcagcacgaccuggugauuccgccuaacggauacuuucgcuucgauuccuggguuaaccaguucuauacucuugcccccauggguaauggcaccgggagaaggcgguga

SEQ ID NO: 20812 - RNA, 1617 nt, Artificial Sequence
  derived and/or modified sequence opt3 from VP1__Norovirus_and/or_Norovirus-like__JQ613573
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccagcucucggaacuacaccaugaaucucgccucccagaacuggaacucauaugauccuacggaggaaaucccagcaccccugggcacuccugacuucguugguaagauucagggggugcuuacacagaccacucgcacagacggaagcacccgaggccacaaggcuacggucuacaccggcagugccgauuuuucuccaaagcuggggagagugcaauucgcuacagacacugauaaugacuuugagaccaaucagaacacaaaauucacucccgucggagugauccaggaugguuccaccacacauaggaaugaaccgcaacaguggguuuugccuagcuacucgggccggaacauccacaaugugcaccucgccccagcaguagcccccaccuuuccuggggagcagcuguuauucuuucguucuacuaugcccggauguuccggcuauccaaacauggaccuggauugccuccuuccucaggaauggguccaauacuucuaucaggaggcugcgcccgcacagucagacguggcccuguugcgcuuuguuaauccagauacggguagagugcuauucgaguguaagcugcauaaaaguggguacgucacaguggcucacaccggccagcaugaccucguaauuccgccuaacggauauuuuagguucgauagcugggugaaccaauucuacacucuggcccccaugggcaaugggaccggacggcgacgcuga

SEQ ID NO: 20813 - RNA, 1617 nt, Artificial Sequence
  derived and/or modified sequence opt3 from VP1__Norovirus_and/or_Norovirus-like__JQ478408
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccaaguucacaccagucggagugguccaggauggcaacggugcucaccaaaaugagccccagcaguggguguugccgucuuacuccgggagaaccggccauaacguucaccucgccccugcaguggccccaacuuuucccggagaacagcuguuauucuuuaggucaacgaugccuggcuguagcggguaccccaacaugaaucuggacugccuccuuccacaagaguggguacagcauuucuaucaggaggcugcgccugcacagagugaugucgcccuguugcgguuugugaaccccgacacaggacguguucuauucgaauguaaacugcacaagucugguuacgugaccgucgcucacacuggccaacaugaucucgugauuccaccgaauggguauuuucgcuucgacuccuggguaaaccaguucuacacccuggccccuaugggaaauggcacagguagaaggcgguga

SEQ ID NO: 20814 - RNA, 1617 nt, Artificial Sequence
  derived and/or modified sequence opt3 from VP1__Norovirus_and/or_Norovirus-like__EF684915
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaaguggaauaaguaugacccgacggaagagauucccgccccucuugggacuccagauuucguaggaaagauccagggcguucugacacagaccacuaaaggcgacgggagcacacgcggacacaaggcuaccaucuacacggguucugcccccuuuaccccuaaauugggcuccgugcaguucucaacagacacugaaaacgauuuugagacccaucaaaauacaaaguucacuccagucggggugacccaggacggaagcacaacccaccgaaacgaaccccagcaauggguccucccgaguuacucuggcagaaaugugcacaacguucaucuggccccugcaguggcuccaacuuuucccggugagcaguuacuguucuuuagguccacgaugccuggguguagcggcuaucccaauauggaucucgacugccuucugccacaggaguggguacagcacuucuaccaagaagcggccccugcacagucggaugucgcuuugcuacgguuugugaaccccgacacaggacguguucuguucgaguguaaacuccauaagucuggcuaugugaccgucgcccacacugggcagcacgaucuggugauuccaccgaauggauacuuucgcuucgacuccuggguaaaccaguucuauacccuugcaccuauggguaacggcacagggagaaggcgguga

SEQ ID NO: 20815 - RNA, 1617 nt, Artificial Sequence
  derived and/or modified sequence opt3 from VP1__Norovirus_and/or_Norovirus-like__HQ456331
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagacucccgccccucuugggacaccagauuucguaggaaagauucagggcguucugacccagacuacaaagggcgacgggagcacccgcggacacaaggcuacgguguacaccgguucugcccccuuuacaccuaaauugggcuccguccaguucucaacugacaccgaaaacgauuuugagacacaucaaaauacuaaguucaccccagugggggucauccaggacggaagcacaacccaccgaaacgaaccccagcaaugggugcucccgaguuacucuggcagaaauguucacaacgugcaucuggccccugcaguagcuccaacuuuucccggugagcaguuacuguucuuuagguccacgaugccuggguguagcggcuaucccaauauggaucucgacugccuucugccacaggaguggguccagcacuucuaccaagaagcggccccugcacagucggauguggcuuugcuacgguuuguuaaccccgacacaggacgugugcuguucgaguguaaacuccauaagucuggcuaugucaccguggcccacacugggcagcacgaucugguaaucccaccgaacggauacuuucgcuucgacuccugggugaaucaguucuauacccuugcaccuauggguaacggcacagggagaaggcgguga

SEQ ID NO: 20816 - RNA, 1617 nt, Artificial Sequence
  derived and/or modified sequence opt3 from VP1__Norovirus_and/or_Norovirus-like__HQ456322
augaagaucgccagcuccgacgcuaaccccucugauggcucaaccgcaaaucuggugccugaggucaacaaugaaguuauggcccucgagccagugguaggggcggcuauugccgcaccgguggccggacagcaaaacgucauagaccccuggaucagaaauaacuucgugcaggcuccugguggcgaauuuacaguuaguccaaggaaugcacccggggagauucuuuggagcgccccucugggaccagauuugaaccccuacuuaucccaccuggcucggauguauaauucuuacgccggcgguuucgaagugcaggucauccuagcggggaacgcauuuacugccggaaaaauuaucuucgcugccgugccuccaaauuuuccgacggagggccucucgcccucacagguaaccauguucccucauauaaucguugacgugcgccaacuggagccaguccuuauuccccugccugaugugcgaaacaauuuuuaucacuacaaccagagcaaugacccaacaaucaaguugauugcaaugcucuauacuccccugcgugcuaacaacgccggcgaugacguguucaccgucaguugcagaguucugacaaggccguccccugauuuugacuucaucuuucucgugcccccaaccguagaaucucggacuaaaccuuucagcgugcccauauuaacagucgaggaaaugaccaauucccgcuuuccaauuccccuggagaaacuuuucacggggccuucaagugcguucgugguucagccacagaacggaagauguacuaccgaugguguguugcugggcacaacucaacuaagcccggucaauaucugcaccuuuagaggggacgugacacauauugccucuacccaggaguacacgaugaaccucgcaucccagaauuggaacaauuaugaucccacugaagagaucccugcuccacugggaacacccgacuucguaggcaagauccaggguguucuuacccaaacuacacggcgcgacgggucaacccgaggacacaaggccacggugagcaccggcaguguccauuuuacaccuaagcugggcaggauucaguucucuacugauaccuccaacgacuuugaaacagggcagaauacuagguucaccccagugggagucgugcaagaugguagcacaacccaccagaacgagccccagcaguggguuuugccgaauuacucgggccgggacucucacaacgugcaucucgcuccugccguagcaccauccuuucccggggaacaacuguuauucuuucguucaacuaugccuggauguaguggcuaccccaauaugaaccuggauugccuccuuccacaggaguggguccagcacuucuaucaggaggccgcuccugcgcaaagcgacguggcacuguugcgcuuuguuaaucccgauacggguagagugcuauucgaauguaaacugcauaaguccggguacgucacaguggcccacaccggccagcacgaccucguaauaccaccgaacggauauuuuagguucgauucuugggugaaccaguucuacacucuggcuccuaugggcaaugggaccggacggcgacgcuga

SEQ ID NO: 20817 - RNA, 1617 nt, Artificial Sequence
  derived and/or modified sequence opt3 from VP1__Norovirus_and/or_Norovirus-like__HM802551
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcucucggacguaccgcaugaaccucgccucccagaauuggaacaauuaugauccgacugaggaaauucccgcaccucuggguacaccagacuucguagggaagauccagggaaugcuuacccagacuacaaagggcgacggcucaacccgagggcacaaggcuacgguuagcaccggaaguguggauuuuacacccaaacuggguucuguccaauucgccacugacaccgauaacgacuuugagacaggccagaauacuagauucaccccugugggggucauccaggauggauccagcacacauaggaacgaaccacaacaguggguguugcccgacuacucgggccggaccguucacaaugugcaccucgcuccggccguagcaccuacuuuuccaggugagcagcuguuauucuuucguucuacgaugcccggguguuccggcuacccuaacauggaucuggacugccuccuuccccaggaauggguccaacauuucuaucaggaggccgcuccaucacagagugauguggcgcuguugcgcuuuguuaauccugacacaggaagagugcuauucgaguguaagcugcacaaagcaggcuacgucaccguggcccauacugggcagcacgaucucguaauucccccaaacggauauuuuagguucgacagcugggugaaucaauucuacacccuggcuccgauggguaacggcgccgggcggcgacgcuga

SEQ ID NO: 20818 - RNA, 1617 nt, Artificial Sequence
  derived and/or modified sequence opt3 from VP1__Norovirus_and/or_Norovirus-like__HM802546
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcacgcggacuuaccgcaugaaccucgccucucagaauuggaacaauuaugauccgacagaggaaauucccgcaccucuggguaccccagacuucguagggaagauccagggaaugcuuacucagacaaccaagggcgacggcuccacgcgagggcacaaggcuaccguuucaacaggaagcguggauuuuacucccaaacuggguaguguccaauucgccaccgacacagauaacgacuuugagacuggccagaauaccagauucacaccugugggggucauccaggauggaucuuccgcucauaggaacgaaccacaacaguggguguugcccgacuacagcggccggaccguucacaaugugcaccucgccccggcaguagccccuacuuuuccaggugagcagcuguuauucuuucguucgacgaugcccggguguucuggcuacccuaacauggaucuggacugccuccuuccccaggaauggguccaacauuucuaucaggaggcugcgccaucccagucagauguggcacuguugcgcuuuguuaauccugacacaggaagagugcuauucgaguguaagcugcacaaagccggcuacgucaccguggcucauacugggcagcacgaucucguaauucccccaaacggauauuuuagguucgacaguugggugaaucaauucuacacccuggccccgauggguaacggcgcagggcggcgacgcuga

SEQ ID NO: 20819 - RNA, 1617 nt, Artificial Sequence
  derived and/or modified sequence opt3 from VP1__Norovirus_and/or_Norovirus-like__GQ856453
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggcaauucuagccggaaaugcuuuuacagccggcaaaaucauuuucgcagcugucccuccaaacuuuccgacugagggccucucccccucucaggugacgauguucccucauaucauaguagacguucgccaacuggagccagugcuuaucccccugccugauguccgaaauaacuuuuaucacuacaaucagucgaacgacucaaccauuaaguugaucgccaugcucuauacaccacugcgugcgaacaaugccggggaagauguguucacugugagcugcagaguccugaccaggcccaguccggacuuugauuucauuuuucucguuccucccacaguggagucccggaccaaaccauucacuguaccuaucuuaacaguggaagagaugaccaacucucgcuuucccauaccacuggagaagcuguucacgggacccagcuccgcauucgucgugcagccucagaaugguagauguacuaccgacggcguuuugcuggggacaacucaacuaucaccagugaacauuugcaccuuuaggggagaugucacacauaucgcuggcagucggaauuacaccaugaaccucgccagccugaauuggaacaauuaugacccgacggaagagauucccgcuccucuugguacuccagauuucguggggaaaauccagggaguacugacacagaccacuaagggcgacggcucuacacgcgggcacaaggccaccguuuacacgggauccgcacccuuuaccccuaaauuggguucacuccaguucagcacagacacugaaaacgauuuugagacccaucaaaauacaaaguucacuccagugggcgucauccaggacgggggaaccacacaccgaaacgaaccccagcaaugggugcugccgaguuacucuggcagaaaugucccuaacgugcacuuagccccagcuguugcgcccaccuuuccuggugagcagcuucucuucuuuagguccacuaugcccggguguagcggcuauccaaauauggaucuugacugccuguugccucaggagugggugcagcauuucuaccaagaagcagcccccgcucagucggauguagcccuacugcgguuugucaacccagacacgggacguguucucuucgaguguaaacugcacaagucuggcuaugugacaguggcacauaccgggcagcacgaucuugucauuccgccuaacggauacuuucgcuucgacuccugggugaaucaguucuauacucuggcccccauggguaacggcaccgggagaaggcgguga

SEQ ID NO: 20820 - RNA, 1617 nt, Artificial Sequence
  derived and/or modified sequence opt3 from VP1__Norovirus_and/or_Norovirus-like__GQ856445
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagucagguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacgucgaucucgacugccuucugccucaggagugggugcagcauuucuaccaagaagcggcacccgcccagucugauguugcuuugcuacgguuugugaauccagacacgggacguguccuguucgaguguaaacuccacaaguccggcuaugugacaguagcccauaccgggcagcacgaucuggugauuccgccuaacggauacuuucgcuucgacucauggguuaaccaguucuauacucuugcacccauggguaauggcaccgggagaaggcgguga

SEQ ID NO: 20821 - RNA, 1617 nt, Artificial Sequence
  derived and/or modified sequence opt3 from VP1__Norovirus_and/or_Norovirus-like__AB541358
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacuguguuaauccugacagucgaagagaugaccaacucucgcuuuccuauaccccuugagaaguuguucacgggaccaagcuccgccuucgugguucagccccagaaugguagauguacuaccgacggcgugcugcuagggacaacucaacucucaccugucaacauuugcaccuuuaggggagaugugacacauaucgcaggcagucggaauuacaccaugaaccuggcuagccuuaauuggaacaauuaugacccaacggaagagauuccggcuccccuggguacuccugauuucguagggaaaauccagggaguuuugacacagaccacuaagggcgacggcucuacacgcgggcacaaggccaccguguacacgggauccgccccauuuacccccaaacucgguucaguccaguucagcacagacacugaaaacgauuuugagauccaucaaaauaccaaguucacaccugugggcgucauucaggacgggaguacuacccaccgaaacgaaccacagcaaugggugcugcccucuuacuccggaagaaauguucacaacgugcauuuagcaccggccguagcuccuacauuuccaggcgagcagcuccucuucuuuaggagcaccaugcccgguuguucgggguauccuaauauggaucuugacugccuguugccccaggaguggguccagcacuucuaccaagaagcggcaccagcccagucugauguggcucuacugcgguuuguuaacccugacacuggccgugugcuguucgaguguaaacugcauaaguccggauaugucacgguggccuacacaggccagcacgaucuuguaauacccccaaacggguauuuucgcuucgacucaugggugaaucaguucuacacccuggcaccgaugggaaacgguacuggcagaaggcgguga

SEQ ID NO: 20822 - RNA, 1617 nt, Artificial Sequence
  derived and/or modified sequence opt3 from VP1__Norovirus_and/or_Norovirus-like__AB541349
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucuacccccuuuacaccuaaauugggcuccguccaguucucaacugacaccgaaaacgauuuugagacacaucaaaauacuaaguucaccccagugggggucauccaggacggaagcacaauucaccgaaacgaaccccagcaaugggugcucccgaguuacucuggcagaaauguucagaacgugcaccuggccccugcaguagccccaaccuuucccggugagcaguuacuguucuuuagguccacuaugccuggguguagcggcuaucccaauauggaucucgacugccuucugccacaggaguggguccaacauuucuaccaggaagcugcgccugcacagucggauguggccuugcuacgguuuguuaaccccgacacgggacgugugcuguucgaguguaaacuccacaagucuggcuaugucacaguggcucauaccgggcagcacgaucugguaauaccaccgaacggauacuuucgcuucgacuccugggugaaucaauucuauacucuugccccuauggguaacggcaccgggagaaggcgguga

SEQ ID NO: 20823 - RNA, 1617 nt, Artificial Sequence
  derived and/or modified sequence opt3 from VP1__Norovirus_and/or_Norovirus-like__AB541342
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccuagcggaccagaucugaaucccuacuugucccacuuagcccggauguucaacgacuaugcgggcgguuuugaagugcaggucauucuggcagggaaugccuucacugcuggaaaaaucauuuuugccgcagugccuccaaacuucccgacggagggccuaucucccucgcagguaaccauguuuccucauaucauaguugaugugcgccagcucgagccaguccugaucccccuuccugacgugcgaaauaacuucuaccacuauaaucaaucaaacgauagcacaauuaagcugaucgcuauguuguacacuccacuccgugccaacaaugcgggcgaagacguguuuaccgucaguugcagaguucugacaaggcccuccccggauuucgacuuuauuuuccuggugccucccaccguagagucucggacuaaaccauuuacagugccuauccucaccgucgaagagaugacgaacagccgcuuccccauaccauuagagaagcuguucacugggcccuccggagccuuugugguucagccucagaaugguagauguaccacagauggcgugcuuuuggggacuacccagcugucaccagucaacauuugcacauucaggggagacgugacccauaucgcaggcagucggaauuauacgaugaaccuagcuagccucaauuggaacaauuacgauccgacugaagagauucccgccccucuggguacaccagacuuuguagggaaaauccaaggaguucuuacccagacuacaaagggcgacggcucuacccgcgggcacaaggcuacgguguauaccggauccgcccccuucacaccuaaacuggguucaguccaguuuagcacugauaccgaaaacgacuucgaggcacaucagaauacaaaguuuacuccagugggcgucauccaagaugggaguaccacacaccgaaacgaaccccagcaguggguguugccgucuuacuccggaagaaauguucaaaacgugcaccucgccccugcuguagcgccaaccuuccccggcgagcagcuguuauuuuucaggagcacuaugccugguuguucgggguaccccaauauggaccuggauugccuccuuccacaggaguggguccagcauuuuuaucaagaagcagccccugcucagucugacguggcccuguugcgguucguuaaccccgauacgggccgugugcuauuugaguguaaacugcacaaguccggauacgucacaguggcacauaccggccagcacgaccucguaauuccaccgaacggguauuuccgcuucgauucaugggugaaucaguuuuacacucuggccccuaugggaaacgguaccggcagaaggcgguga

SEQ ID NO: 20824 - RNA, 1617 nt, Artificial Sequence
  derived and/or modified sequence opt3 from VP1__Norovirus_and/or_Norovirus-like__AB541248
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacuccuacgcgggcgguuucgaagugcaggucauucuagcagggaaugccuuuacagcuggaaaaaucauuuucgccgcagugccuccaaacuuuccgacugagggccucucucccucgcagguaacgauguucccucauaucauaguugacgugcgccaacuggagccaguccuuaucccccugccugaugugcgaaauaacuuuuaucacuacaaucagucaaacgacagcaccauuaaguugaucgcuaugcucuauacaccacugcgugccaacaaugcgggcgaagauguguucacugucaguugcagaguucugaccaggcccuccccggacuuugauuucauuuuucucgugccucccacaguagagucucggaccaaaccauucacugugccuaucuuaacagucgaagagaugaccaacagccgcuuucccauaccacuggagaaacuuuucacggggcccuccucagccuucgugguucagccucagaauggaagauguacuaccgacgguguguugcugggcacaacucaacuaaguccagucaacauuugcaccuuuaggggagaugugacacauaucgcagggagccggaauuacaccaugaaccucgcuucucugaauuggaacaauuaugacccgacggaagagauucccgccccucuuggcacuccagauuucguagguaagauccaggggguucugacacagaccacuaagggagacggcuccacacgcggccacaaggcuaccguguacacggggucagcccccuuuaccccuaaauugggaagcguccaguucaguacagacacugaaaacgauuuugagacccaucaaaauacaaaguucacuccagugggugucauccaggacggcgggaccacacaccgaaacgaaccccagcaaugggugcucccgucuuacuccggaagagauguucacaaugugcaucuggccccugcaguagcuccaaccuuucccggcgagcaguuacuguucuuuaggagcacuaugccugguuguucgggguaucccaacauggaccucgauugccuucugccacaggaguggguccagcacuucuaccaagaagcggccccugcacagucugacguggcuuugcuacgguuuguuaaucccgauacgggccgugugcuguucgaguguaaacuccauaaguccggauaugucacaguggcccacaccggccagcacgaccugguaauuccaccgaacggguacuuucgcuucgauucaugggugaaccaguucuauacucuugcaccuaugggaaaugguaccggcagaaggcgguga

SEQ ID NO: 20825 - RNA, 1617 nt, Artificial Sequence
  derived and/or modified sequence opt3 from VP1__Norovirus_and/or_Norovirus-like__GQ246798
augaagauggccagcuccgacgcuaaccccuucgauggcucuaccgcaaaucuggugccugaggucaacaaugaaguuauggcccucgagccagugguaggggcggcuaucgccgcaccgguggccggacagcaaaacgucauugaccccuggauaagaaauaacuuugugcaggcuccugguggcgaguucacaguuucaccaaggaaugcacccggggaaauccuuuggagugccccucugggaccagauuugaaccccuacuuaagccaccuggcucggauguauaauggcuacgccgguggguuugaagugcaggucauucuagcgggaaacgcauucacugccggcaaaaucauuuuugcugccgugccuccaaauuucccgacggagggccucucccccucucagguaaccauguuuccucauaucauaguugacgugcgccaacuggagccaguccuuaucccccugccugaugugcgaaacaauuucuaucacuacaaccagucgaaugacccaacaauuaaguugaucgcaaugcucuauacuccccugcgugcuaacaacgccggggaugacguguuuaccgucucaugcagaguucugacaaggccgagcccugauuucgacuuuauuuuccucgugcccccaaccguagaaagucggacuaaaccuuuuuccgugcccaucuuaacagucgaggaaaugaccaauucucgcuucccaauaccccuggagaaacuuuucacgggaccuagcuccgcguuugugguucagccacagaacgguagauguacuaccgauggcguguugcuggggacaacucaacuaucaccggucaauauuugcaccuucaggggagacgugacacauaucaccggcagucggaacuacacgaugaaucucgccacucagaacuggaauagcuaugaucccacagaggaaauuccugcaccacuggguacccccgacuuuguagggaagauccagggaguucuuacucagacaacccgcgcugacggcucuacgcgaggccacaaggccaccguguacacaggguccgcugauuucgccccuaagcugggaagaguccaauuugcaacugacaccgauaacgacuucgaugccaaucagaacacaaaauuuacuccagugggugucauccaggacggcaauaccgcucauaggaacgagccccaacaguggguguugccgucauacagcgggcggaauagucacaacguucaccucgcgccugcaguggccccaacauuccccggagaacagcuguuauuuuuccguucuaccaugccuggcuguuccgguuaucccaauauggaucuggacugccuccuuccacaggaguggguacaauacuuuuaucaggaagcugccccugcacagagcgaugucgcccuguugcgcuucgugaaccccgacacugggagaguucuauuugaguguaagcugcauaaaucgggcuacgugacggucgcucacacaggacagcaugaucucgugauuccaccgaacggcuauuucagguucgacucuuggguaaaucaauuuuacacccuggccccuauggggaacggaacuggucggcgacgcuga

SEQ ID NO: 20826 - RNA, 1617 nt, Artificial Sequence
  derived and/or modified sequence opt3 from VP1__Norovirus_and/or_Norovirus-like__GQ246791
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucgcaucauaguugacgugcgacaacuggagccaguccuuaucccccugccugaugugcguaauaacuuuuaucauuacaaucagucgaacgacccaacaauuaaguugaucgcaaugcucuauacuccccugagagcuaacaaugccggggaugacguguucaccgucucaugcaggguucugacacggccgagcccugauuuugacuucauuuuucucgugcccccaaccguagaaagucgcacuaaaccuuucacagugcccaucuuaaccgucgaggaaaugacgaacuccagauuuccaauaccccuggagaggcuuuacacuggaccuucuagcgcguucgugguucagccacagaauggucgguguaccacagauggcguguugcuggggacuacccaacuauccgccgucaacauuugcacauuccgcggagacgugacccacaucgcaggcucacgaaauuauacgaugaaccucgcuagucagaauuggaacaauuacgauccgacugaggaaauucccgccccucuggguacaccagacuuuguagggaagauccagggaaugcuuacccagacuacaagaagcgacggcucuaccaggggccauaaagcuacgguucugaccggguccgccgauuucgcacccaaguugggacgggugcaauuugccacagacacugauaacgacuucgagucaggucagaauaccaaguuuacaccugucggcgugauccaggaugggagcacuacccaccguaacgaaccacaacaguggguccuccccaauuacaguggacgcacaggccauaacgugcaccuggcuccggcgguugcaccuaccuauccaggugagcaguuacuguucuuuagaucuacuaugcccggguguuccggcuacccuaauauggaccucgauugccuuauuccccaggacugggugcaacacuucuaucaggaagccgcuccagcccagagcgauguagcacuguugagguuugucaacccugacacgggacgggugcuauucgaguguaaacugcauaagucgggcuacguuacaguggcccacaccgggcagcaugaucucgucauacccccaaacggauauuuucgauucgacucuugggugaaucaauuuuacacucuggcuccgauggguaacggcaccgggcgcagaagguga

SEQ ID NO: 20827 - RNA, 1617 nt, Artificial Sequence
  derived and/or modified sequence opt3 from VP1__Norovirus_and/or_Norovirus-like__GU350225
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgccaccgacacagauaacgacuuugagacuggccagaauaccagauucacaccagugggggucauccaggauggaaguucuacccauaggaacgaaccccaacaguggguguugccggacuacuccggccggacugcucacaauguucaccucgccccugcaguggccccaacguuucccggugagcagcuguuauucuuucguagcacaaugccuggguguucgggcuaccccaacauggaucuggacugccuccuuccacaggaauggguacaacauuucuaucaggaggcugcgccuucucaguccgaugucgcacuguugcgcuuugugaaucccgacaccggaagaguucuauucgaguguaagcugcacaaagccggcuacgugacugucgcucauaccgggcagcacgaucucgugauuccaccgaacggauauuuuagguucgacucauggguaaaucaauucuacacacuggccccuauggguaacggcgcagggcggcgacgcuga

SEQ ID NO: 20828 - RNA, 1617 nt, Artificial Sequence
  derived and/or modified sequence opt3 from VP1__Norovirus_and/or_Norovirus-like__AB504319
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagaggugaccaacucucgcuuucccauaccacuggagaaacuuuucacgggacccagcggugccuucguugugcagccucagaauggcagauguacuaccgacggggucuugcugggaacaacucaacuauccccagugaacauuugcaccuuuaggggcgauguaacacauaucgcagguacccggaauuacacgaugaaccucgcuucacugaauuggaacaauuaugacccgacugaagagauucccgccccucuugggacaccagauuucguuggaaagauccagggcgugcugacccagacuacaaagggcgacgggaguacccgcggacacaaggcuacggucuacaccgguagcgcccccuuuacaccuaaauugggcucugugcaguucuccacugacaccgaaaacgauuuugagacacaucaaaauacuaaguucaccccagucggggugauccaggacggaggcacaacccaccgaaacgaaccccagcaauggguucucccgucauacagcgguagaaaugugcacaacguacaucuggccccugcagucgcuccaacuuuucccggggagcaguuacuguucuuuaggaguacgaugccuggcuguucuggauaucccaauauggaucucgacugccuucugccacaggagugggugcagcacuucuaccaagaagcggccccugcacaguccgauguugcuuugaugcgguuugugaaccccgacacaggccguguccuauucgaguguaaacugcauaagagcggguaugugaccguagcccacacuggacagcacgaucucgugauuccaccgaacgguuacuuucgcuucgacucguggguuaaucaguucuauacccuggcaccuaugggcaacgggacaggaagaaggcgguga

SEQ ID NO: 20829 - RNA, 1617 nt, Artificial Sequence
  derived and/or modified sequence opt3 from VP1__Norovirus_and/or_Norovirus-like__AB447458
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacggggccuucaagugcguucguugugcagccacagaacggaagauguacuaccgauggugucuugcugggcacaacucaacuaagcccggugaauauaugcaccuuuaggggagacguaacacauauugccgggacccaggaguacacgaugaaccucgcaucucagaauuggaacaauuaugaucccacugaagagaucccugcuccacugggcacacccgacuucguugguaagauucagggggugcuuacccaaacuacacggcgcgacggauccacccgaggccacaaggccacggucucaaccggcagcgugcauuuuacaccuaagcuggggagaauccaguucaguacugauaccucuaacgacuuugaaacaggacagaauacuagguucaccccagucggugugguucaagauggcgggacaacccaccagaacgagccccagcaguggguguugccgaauuacuccggacgggacagccacaacguacaucucgcuccugccgucgcaccaucguuucccggcgaacaacuguuauucuuucguucuacuaugccugguuguuccggguaccccaauaugaaccuggauugccuccuuccacaggagugggugcagcacuucuaucaggaggccgcuccugcgcaaucagacguugcacuguugcgcuuugugaaucccgauacgggcagaguccuauucgaauguaaacugcauaagaguggauacgugacaguagcccacaccggccagcacgaccucgugaucccaccgaacggguauuuuagguucgauagcuggguuaaccaguucuacacucuggcuccuaugggaaaugguaccggccggcgacgcuga

SEQ ID NO: 20830 - RNA, 1617 nt, Artificial Sequence
  derived and/or modified sequence opt3 from VP1__Norovirus_and/or_Norovirus-like__AB385640
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccugucucggauguauaauucguacgcuggcgguuucgaagugcaggucauucuagccgggaacgcguuuacugcaggaaaaaucauuuucgccgcugugccuccaaauuuuccgaucgagggccucucacccagccagguaacgauguucccucauauaaucguugacgugcgccaacuggagccaguccuuauuccccugccugaugugcgaaacaauuuuuaucacuacaaccagaguaaugacccaaccaucaaguugauugccaugcucuauacaccccugcgugcaaacaacgcuggcgaugacguguucacugucuccugcagaguucugaccaggccgucuccugauuuugacuucaucuuucucgugcccccaacaguagaaagccggaccaaaccuuucuccgugcccauauuaacugucgaggaaaugacaaauucacgcuuuccaacccccguggagaagcuguucacggggccuaguagcgccuucauuguucagccacagaacggaagauguacuaucgauggugugcuuuugggcaccacacaacugucuccggucaauauuugcacuuuuaggggagacgugacccauaucgcggggacacaggaguacaccaugaaccuagccucccagaauuggaacaauuaugaucccacggaagagaucccugcaccacucggcacucccgacuucguagguaaaauucaggggguucugacacaaaccacucggcgcgacggaucaacacgaggccacaaggcuaccgugagcacgggcaguguccauuuuaccccuaaacuugggagaauacaguucucuacagauacuuccaacgacuuugaaaccaggcagaauacacgguucacuccagugggagucauccaagaugguagcaccacacaccagaacgagccccagcagugggugcugccgaauuacucgggccgugacucucacaacguucauuuggccccugcuguggccccauccuuucccggggaacaacuccuguucuuucgcucaaccaugccuggauguaguggcuaccccaauaugaacuuagauugccugcucccacaggaguggguacagcacuucuaucaggaggcagccccugcucaaagcgacgucgcgcuucugagauuugugaaucccgauacugguaggguuauguucgaauguaaguugcauaaguccggguacauuacgguggcacacacaggccagcacgaccuagucaucccaccgaacggauauuuucgguucgaugccugggugaaccaguucuacacccuggcuccuaugggcaaugggacuggacgacgcagauga

SEQ ID NO: 20831 - RNA, 1617 nt, Artificial Sequence
  derived and/or modified sequence opt3 from VP1__Norovirus_and/or_Norovirus-like__AB385633
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucguguucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacagcacaaucaaguugauugcaaugcucuauacuccacugcgugcuaacaacgccggggaugacgucuucaccguuaguugcagagugcugacaaggcccuccccggauuuugacuucaucuuucucguaccucccaccguggaaucucggacuaaaccauucagcgucccuauuuuaacaguggaggaaaugaccaauucccgcuuucccaucccacuggagaaacuuuucacgggacccucaagugcguucauaguucagccucagaacgguagauguacuaccgauggcguguugcuggggacaacucaacuaagcccagucaauauuugcaccuuuaggggagacgugacacauaucgccggcacccaggaguacacgaugaaccucgcaucucagaauuggaacaauuaugauccgacugaagagauucccgcuccucuggguacaccagacuucguagggaagauccagggaguucuuacccaaacuacacggcgcgacggcuccacccgaggccacaaggccacggugucaaccgggagcguccauuuuacacccaagcugggaagaauccaguucaguacugauaccucuaacgacuuugaaacaggucagaauacuagguucaccccugugggcgucgugcaagauggguccacaacccaccagaacgagccacagcaguggguuuugcccaauuaccucggacgggacagccacaacgugcaucuggcuccggccguagcaccuucguuuccaggcgaacaauuacuguucuuucguucuacuaugcccgguuguuccggguacccuaauaugaaccucgauugccuucugccccaggaguggguccagcacuucuaucaggaggccgcuccagcgcaaucagacguggcauugcuacgcuuuguuaauccugauacgggcagagugcuguucgaauguaaacuccauaagaguggauacgucacaguggcccacaccggccagcacgaccugguaauucccccaaacggguauuuuagguucgauagcugggugaaccaguucuacacucuugcuccgaugggaaaugguaccggccggcgacgcuga

SEQ ID NO: 20832 - RNA, 1617 nt, Artificial Sequence
  derived and/or modified sequence opt3 from VP1__Norovirus_and/or_Norovirus-like__DQ658413
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgacacgcacaauuacacuaugaaccucgcaucccagaauuggaacaauuaugaucccacagaagagauuccugcuccacuggguacccccgacuucguagggaagauccagggaaugcuuacucagacaacccggggcgacggcucaacgcgcgggcauaaggccaccguuaguacaggagaugugcacuuuacuccuaagcuggguagcauccaauucaacaccgacacaaauaacgauuuugaaacuggccagaauaccaaauucacaccagucggggugguccaggacggaaacggcacccaccaaaaugagccccagcaguggguguugccgucuuacuccggucgaacugggcauaacguucaccucgcuccugccguggcaccaacguuucccggcgaacagcuguuauucuuuagaucaacaaugccuggauguagcggcuaccccaacaugaaucuggauugccuccuuccacaagaguggguacagcauuucuaucaggaggccgcuccugcgcagagugacgucgcacuguugagguuugugaaccccgauaccgggcggguucuauucgaauguaagcugcacaaaucuggauacgugacugucgcccacaccggucaacaugaccucgugauuccaccgaauggcuauuuucguuucgauuccuggguaaaccaguucuacacacuggcuccuauggggaauggaaccggccgcagaagguga

SEQ ID NO: 20833 - RNA, 1617 nt, Artificial Sequence
  derived and/or modified sequence opt3 from VP1__Norovirus_and/or_Norovirus-like__AB220923
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcacgcggacuuaccgcaugaaccucgccucucagaauuggaacaauuaugauccgacagaggaaauucccgcaccucuggguaccccagacuucguagggaagauccagggaaugcuuacucagacaaccaagggcgacggcuccacgcgagggcacaaggcuaccguuucaacaggaagcguggauuuuacucccaaacuggguaguguccaauucgccaccgacacagauaacgacuuugagacuggccagaauaccagauucacaccugugggggucauccaggauggaucuuccacccauaggaacgaaccacaacaguggguguugcccgacuacagcggccggacuguucacaaugugcaccucgcuccggccguagcaccuacguuuccaggugagcagcuguuauucuuucguucgacaaugcccggguguucuggcuacccuaacauggaucuggacugccuccuuccccaggaauggguccaacauuucuaucaggaggccgcuccaucccagucagauguggcgcuguugcgcuuuguuaauccugacaccggaagagugcuauucgaguguaagcugcacaaagcaggcuacgucacuguggcccauaccgggcagcacgaucucguaauucccccaaacggauauuuuagguucgacaguugggugaaucaauucuacacacuggcuccgauggguaacggcgccgggcggcgacgcuga

SEQ ID NO: 20834 - RNA, 1617 nt, Artificial Sequence
  derived and/or modified sequence opt3 from VP1__Norovirus_and/or_Norovirus-like__AY588016
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccaaguucacaccagucggagugguccaggauggcaacgguacccaccaaaaugagccccagcaguggguguugccgucuuacuccgggagaacuggccauaacguucaccucgcuccugccguggcaccaacguuucccggagaacagcuguuauucuuuaggucagccaugccuggcuguagcggguaccccaacaugaaucuggacugccuccuuccacaagaguggguacagcauuucuaucaggaggcugcgccugcacagagugaugucgcccuguugcgguuugugaaccccgacacaggacguguucuauucgaauguaaacugcacaagucugguuacgugaccgucgcucacacuggccaacaugaucucgugauuccaccgaauggguauuuucgcuucgacuccuggguaaaccaguucuacacccuggccccuaugggaaauggcacagguagaaggcgguga

SEQ ID NO: 20835 - RNA, 1617 nt, Artificial Sequence
  derived and/or modified sequence opt3 from VP1__Norovirus_and/or_Norovirus-like__AY502022
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccaaguucacaccagucggagugguccaggauggcaacgguacccaccaaaaugagccccagcaguggguguugccgucuuacuccgggagaacuggccauaacguucaccucgcuccugccguggcaccaacguuucccggagaacagcuguuauucuuuaggucaacaaugccuggcuguagcggguaccccaacaugaaucuggacugccuccuuccacaagaguggguacagcauuucuaucaggaggccgcuccugcgcagagugaugucgcacuguugcgguuugugaaccccgacaccggacguguucuauucgaauguaaacugcacaagucugguuacgugacugucgcccacaccggccaacaugaucucgugauuccaccgaauggguauuuucgcuucgacuccuggguaaaccaguucuacacacuggcuccuaugggaaauggcaccgguagaaggcgguga

SEQ ID NO: 20836 - RNA, 1617 nt, Artificial Sequence
  derived and/or modified sequence opt3 from VP1__Norovirus_and/or_Norovirus-like__KX158280
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcagcacuacccacaggaaugagccccaacaguggguauugccgaguuacucugggcggaacacaccuaauguccaccucgccccagcuguggcgcccaccuuuccuggagaacagcuguuauucuuucguuccacuaugcccggcuguagcgguuauccaaacauggaccuggauugccuccuuccucaggaguggguucaauacuucuaucaggaggcagcccccgcucagucggacguggcccuguugcgcuuugucaauccagauacggggagagugcuauucgaauguaagcugcauaaaucuggcuacguaacaguggcacacaccggacagcaugaccucguuauuccgccuaacggcuauuuuagguucgauuccugggucaaccaauucuacacucuggcccccauggggaauggaaccggucggcgacgcuga

SEQ ID NO: 20837 - RNA, 1617 nt, Artificial Sequence
  derived and/or modified sequence opt3 from VP1__Norovirus_and/or_Norovirus-like__KX371606
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcagcacuacccacaggaaugagccccaacaguggguauugccgaguuacucugggcggaacacacacaauguccaucucgccccugcuguggcgccaaccuuucccggagaacagcuguuauucuuucguuccacuaugccuggcuguagcgguuaucccaacauggaccuggauugccuccuuccacaggaguggguucaauacuucuaucaggaggcagccccugcucagucggacguggcccuguugcgcuuugucaaucccgauacggggagagugcuauucgaauguaagcugcacaaaucuggcuacguaacaguggcacauaccggacagcacgaccucguuauuccaccgaacggcuauuuuagguucgauuccugggucaaccaauucuacacucuggccccuauggggaauggaaccggucggcgacgcuga

SEQ ID NO: 20838 - RNA, 1617 nt, Artificial Sequence
  derived and/or modified sequence opt3 from VP1__Norovirus_and/or_Norovirus-like__KX371605
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaguaccaaauucacaccaguuggugugauccaggauggcucuacuacccacaggaaugagccccaacaguggguauugccguccuacagcgggcggaacacaccuaauguccaccucgccccagcuguggcgcccaccuuuccuggagaacagcuguuauucuuucguucgacuaugcccggcuguucugguuauccaaacauggaccuggauugccuccuuccucaggaguggguucaauacuucuaucaggaggcagcccccgcucaguccgacguggcccuguugcgcuuugucaauccagauacggggagagugcuauucgaauguaagcugcauaaaucaggcuacguaacaguggcacacaccggacagcaugaccucguuauuccgccuaacggcuauuuuagguucgauaguugggucaaucaauucuacacucuggcccccauggggaacggaaccggucggcgacgcuga

SEQ ID NO: 20839 - RNA, 1617 nt, Artificial Sequence
  derived and/or modified sequence opt3 from VP1__Norovirus_and/or_Norovirus-like__KX354128
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaaaauccagggacuguugacacagaccacuaagggcgacggcucuacacgcgggcacaaggcuaccguuuacacgggauccgcccccuuuaccccuaaacucgguucagugcaguucgaaacagacacugagaacgauuuugaaacccaucaaaauacaaaguucacuccagucggcgugauccaggacgggggaaccacacaccgaaacgagccccagcaauggguccugccgagcuacaguggcagaaaugugccuaacguucacuuagcaccagccguggcucccaccuuuccuggugagcagcuucucuucuuuaggucuacuaugcccggguguuccggcuauccaaauauggaucuugacugccuguugccucaggaauggguacagcauuucuaccaagaggcggcacccgcccagagcgaugucgcucuacugcgguuugugaacccagacacgggacguguucucuucgaauguaaacugcacaagucgggcuaugugacagucgcccauaccgggcagcacgaucuugugauuccgccuaacggauacuuucgcuucgacucuuggguaaaucaguucuauacucuggcacccauggguaacggcaccgggagaaggcgguga

SEQ ID NO: 20840 - RNA, 1617 nt, Artificial Sequence
  derived and/or modified sequence opt3 from VP1__Norovirus_and/or_Norovirus-like__KX354099
augaagauggccagcuccgacgcuucucccucagauggcagugcagccagccuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuuccccaaggaaugcccccggggagauccuuuggucugcuccucugggaccagauuugaaccccuacuuaucgcaccuggcccggauguauaauggcuacgcggguggguucgaagugcaggucauucuagcaggaaacgccuuuacagcuggcaaagugaucuucgccgcaguaccuccaaauuuuccgacugagggccucucacccagccagguuacgauguucccucauauuguggucgacgugcgccaacuggagccagugcuuaucccccugccugauguccgaaacaauuuuuaucacuacaaccaguugaaugacccaaccauaaagcucaucgcuaugcuguauacaccccugcgugccaacaaugcgggggaugacguuuucacugugaguugcagaguacucaccaggccguccccugauuuugacuucaucuuuuuagugcccccaacagucgaaucucggaccaaaccuuucagcgugcccguucugacuguggaggaaaugacaaacucccgcuuuccaauuccccuugagaaguuguucaccggaccuucaagugccuucgucgugcagccacagaacgguagauguacgacugauggcguacugcuagggaccacacaacucagcccgguuaauauuugcacuuuuaggggagacgugacccauaucacaggcucucacaacuacaccaugaaucuggcaucccagaacuggaauaacuaugaucccacggaggaaauaccugcuccacuugguacucccgacuucgucgggaaaauucagggagugcugacacagaccacucgggccgacggcucaacacgcggccauaaggcuaccgucuacacggggagcgccgauuuugcaccuaaguugggacgagugcaauucgagaccgacacagaucacgacuuugaaacuaaucagaacaccaaauucacaccaguuggugugauccaggauggcgggacuacccacagaaaugagccccaacaguggguacucccgaguuacucuggaaggaacacacauaauguccaccuggccccugcuguggcgccaaccuuucccggcgaacaguuacuguucuuucgguccacuaugccugguuguagcggguaucccaacauggaccucgauugccuucugccacaggaguggguucaauacuucuaucaggaggcagccccugcucagucggacguggccuugcuacguuuugucaaucccgauacgggccgcgugcuguucgaauguaagcuccauaaaucuggauacguaacaguggcacacaccggccagcacgaccugguuauuccaccgaacggguauuuuagauucgauuccugggucaaucaauucuacacucuugccccuaugggaaacggugcuggcaggcggcgauga

SEQ ID NO: 20841 - RNA, 1617 nt, Artificial Sequence
  derived and/or modified sequence opt3 from VP1__Norovirus_and/or_Norovirus-like__KX354087
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaauuauucacugugccaauccugacagucgaggaaaugaccaacucucgcuuuccuauaccccuugagaaguuguucacgggaccaagcuccgccuucgugguucagccccagaaugguagauguacuaccgauggcgugcugcuagggacaacucaacucucaccugucaacauuugcaccuuuaggggagacgugacacauaucgcaggcagucggaauuacaccaugaaccuggcuagccuuaauuggaacaauuaugauccaacggaggaaauuccggcuccccuggguacuccugacuucguagggaaaauccagggaguuuugacacagaccacuaagggcgacggcucuacacgcgggcacaaggccaccguguacacgggauccgccgauuuuaccccaaaacucgguucaguccaguucgcaacagacacugagaacgauuuugaaauccaucaaaauacccgauucacacccgugggcgucauucaggacgggggaacuacccacagaaacgagccucagcaaugggugcugccaagcuacaguggcaggaauguucacaacgugcauuuagcccccgcuguagcgccgaauuuuccuggugaacagcuccucuucuuucggucuacaaugccaggguguuccggcuaucccaacauggaucuugacugccuguugccucaggaguggguccagcacuucuaccaagaggcagcccccgcucagagcgauguggcccuacugcguuuuguuaacccagacaccggacgcgugcuguucgaauguaagcugcauaaaucgggcuaugucacuguggcacacacggggcaguacgaucuuguaauaccucccaauggauauuuuagauucgacucuugggugaaccaguucuacacacuggccccaauggguaauggcaccgggaggcggcgauga

SEQ ID NO: 20842 - RNA, 1617 nt, Artificial Sequence
  derived and/or modified sequence opt3 from VP1__Norovirus_and/or_Norovirus-like__KX354009
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaugacccaaccaucaaguugauugcuaugcucuauacaccccugcgugccaacaacgcgggggaugacgucuucacuguuagcugcagagugcugaccaggccgaguccugauuuugacuucaucuuucucguacccccaacaguggaaucccggaccaaaccuuucucuguccccguguuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacuggaauaacuaugaucccacggaggaaauuccugcuccacuggguacucccgacuucguggggaagauccagggaguccuuacacagaccacucgcacagacggcuccacccgaggccacaaggccacgguguacaccgggucagcugauuuugccccuaagcugggaagaguccaauucgagacagacacugaucaugacuuugaagcaaaucagaacaccaaauucacaccaguggguguuauucaggauggcagcacuacccacaggaaugagccccaacaguggguguugccgaguuacucugggcggaacacacacaauguacaucucgccccugcugucgcgccaaccuuucccggagaacagcuguuauucuuucguuccacuaugccuggcuguagcgguuaucccaacauggaccuggauugccuccuuccacaggagugggugcaauacuucuaucaggaggcagccccugcucagucggacguugcccuguugcgcuuugugaaucccgauacggggagaguccuauucgaauguaagcugcacaaaucuggcuacgugacaguagcacauaccggacagcacgaccucgugaucccaccgaacggcuauuuuagguucgauuccuggguuaaccaauucuacacucuggccccuauggggaauggaaccggucggcgacgcuga

SEQ ID NO: 20843 - RNA, 1617 nt, Artificial Sequence
  derived and/or modified sequence opt3 from VP1__Norovirus_and/or_Norovirus-like__KR131784
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaauauggcaucucagaacuggaauaacuaugaucccacggaggaaauaccugcuccacucgguacucccgacuucgucgggaagauucagggagugcugacacagaccacucgcacagacggcuccacccgaggccacaaggccacggucuacaccgggucagcugauuuugccccuaaacuuggaagagugcaauucgagacagacacugaucaugacuuugaagcaaaucagaacaccaaguucacaccaguuggugugauccaggauggcagcacuacccacaggaaugagccccaacaguggguacugccgaguuacucugggcggaacacacacaauguccauuuggccccugcuguggcgccaaccuuucccggagaacagcuccuguucuuucguuccacuaugccuggcuguagcgguuaucccaacauggacuuagauugccugcucccacaggaguggguucaauacuucuaucaggaggcagccccugcucagucggacguggcccuucugcgcuuugucaaucccgauacggggagaguguuguucgaauguaagcuacacaaaucuggcuacguaacaguggcacauaccggacagcacgaccugguuauuccaccgaacggcuauuuuagguucgauuccugggucaaccaauucuacacucucgccccuauggggaauggaaccggucggcgacgcuga

SEQ ID NO: 20844 - RNA, 1617 nt, Artificial Sequence
  derived and/or modified sequence opt3 from VP1__Norovirus_and/or_Norovirus-like__AB972527
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcaguacuacccaucggaacgagccccaacaguggguauugccgucuuacuccgggcguuauacaccuaauguccaccucgccccagcuguggcgcccaccuuuccuggagaacagcuguuauucuuucgcagcacuaugcccggcuguucggguuacccaaacauggaccuggauugccuccuuccucaggaguggguucaauauuucuaccaggaggcagcccccgcucagucugacguggcccuguugagauuugucaauccagauacggggagggugcuauucgaauguaagcugcacaaauccggcuauguaacaguggcacauaccggacagcacgaccucguuauuccgccuaacggcuacuuucgguucgauucaugggucaaucaauucuauacucuggcccccauggggaacggaaccggucgacgcagauga

SEQ ID NO: 20845 - RNA, 1617 nt, Artificial Sequence
  derived and/or modified sequence opt3 from VP1__Norovirus_and/or_Norovirus-like__AB972525
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucgaaacagacacugagaacgauuuugaaacccaucaaaauacaaaguucacuccagucggcgugauccaggacgggggaaccacacaccgaaacgagccccagcaauggguccucccgagcuacaguggcagaaaugugccuaacguucaccuggcaccagccguggcucccaccuuuccuggugagcaguuacuguucuuuaggucuacuguacccggguguuccggcuauccaaauauggaucucgacugccuucugccucaggaauggguccagcauuucuaccaagaggcggcacccgcccagagcgauguggcuuugcuacgguuuguuaacccagacacgggacgugugcuguucgaauguaaacuccacaagucgggcuaugucacaguggcccauaccgggcagcacgaucugguaauuccgccuaacggauacuuucgcuucgacucuugggugaaucaguucuauacucuugcacccauggguaacggcaccgggagaaggcgguga

SEQ ID NO: 20846 - RNA, 1617 nt, Artificial Sequence
  derived and/or modified sequence opt3 from VP1__Norovirus_and/or_Norovirus-like__KT780388
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauacaaccggcagccacaacuacacgaugaaucucgcaucucagaacugguccaauuaugaucccacugaggaaaucccugcuccacuggguacacccgacuucgucgggaagauacagggagugcuuacccagacuacacggaccgacggcucaacgcgcggccauaaggccaccgucuacacagggagcgcugauuuugccccuaagcugggacgagugcaauucgcaacugacaccgaucacgacuuugaggccaaccagaauacaaaauucacuccaguuggugugauucaggauggcgggaccacacacagaaacgaaccccaacaguggguauugccgaguuacucuggaaggaauaccccuaacguccaucucgcuccagcgguggcacccacuuuuccuggcgagcagcuguuauucuuucgguccacgaugcccgguuguagcggguauccaaauauggaccuggauugccuccuuccucaggaauggguucaauacuucuaucaggaggccgcucccgcccagucggacguggcacuguugcguuuugucaacccagauacaggccgcgugcuauucgaguguaagcugcacaaaucuggauacguaaccguggcccauacuggccagcacgaccucguuaucccgccuaauggguauuuuagauucgauuccugggucaaccaauucuacacccuggcucccaugggaaacgguacaggcaggcggcgauga

SEQ ID NO: 20847 - RNA, 1617 nt, Artificial Sequence
  derived and/or modified sequence opt3 from VP1__Norovirus_and/or_Norovirus-like__KT780373
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgcaacagacacugaucacgacuuuguugccaaccagaauaccaaauucacaccaguggguguaauccaggauggcgggacuacccacagaaacgagccccaacagugggucuugccgaguuacucuggaaggaauacaccuaacgugcaucucgcuccagcgguugcacccaccuuuccuggcgaacagcuguuauucuuucgguccacuaugcccgguuguagcggguauccaaauauggaccuggauugccuccuuccucaggagugggugcaauacuucuaucaggaagccgcucccgcccagucggacgucgcacuguugcguuuugugaacccagauacgggccgcguacuauucgaguguaagcugcacaaaucuggauacgugacaguugcccauaccggccagcacgaccucgucauuccgccuaauggguauuuuagauucgauuccugggugaaccaauucuacacucuggcucccaugggaaacgguaccggcaggcggcgauga

SEQ ID NO: 20848 - RNA, 1617 nt, Artificial Sequence
  derived and/or modified sequence opt3 from VP1__Norovirus_and/or_Norovirus-like__AB933723
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacuccuacgcgggcgguuucgaagugcaggucauucuagcagggaaugccuuuacagcuggaaaaaucauuuucgccgcagugccuccaaacuuuccgacugagggccucucucccucgcagguaacgauguucccucauaucauaguugacgugcgccaacuggagccaguccuuaucccccugccugaugugcgaaauaacuuuuaucacuacaaucagucaaacgacagcaccauuaaguugaucgcuaugcucuauacaccacugcgugccaacaaugcgggcgaagauguguucacugucaguugcagaguucugaccaggcccuccccggacuuugauuucauuuuucucgugccucccacaguagagucucggaccaaaccauucacugugccuaucuuaacagucgaagagaugaccaacagccgcuuucccauaccacuggagaaacuuuucacggggcccuccucagccuucgugguucagccucagaauggaagauguacuaccgacgguguguugcugggcacaacucaacuaaguccagucaacauuugcaccuuuaggggagaugugacacauaucgcaagcucucggaauuacaccaugaaccucgcuucccugaauuggaacaauuaugacccgacggaagagauucccgccccucuugggacuccagauuucguaggcaagauccaggguaugcugacacagaccacuaagggggacggaucaacacgcggccacaaggcuaccguuuacacgggcagcgcccccuuuaccccuaaauuggggagugugcaguucucuacagacacugaaaacgauuuugagacccaucaaaauacaaaguucacuccagucggagugauccaggacgguuccaccacacaccgaaacgaaccccagcaauggguccucccgagcuacucgggcagaaaugugccuaacguucaccuggcaccagccguggcucccgcguuuccuggggagcaguuacuguucuuuaggucuaccaugcccggauguuccggcuauccaaauauggaucucgacugccuucugccucaggaguggguacagcauuucuaccaagaagcagcccccgcucagucagaugucgccuugcuacgguuugugaacccagacacuggucguguucuguucgaguguaaacuccacaagaguggguaugugacggucgcacauacaggccagcacgaucuggugauuccgccuaacggauacuuucgcuucgacagcuggguaaaucaguucuauacccuugcccccaugggcaacgggacuggaagaaggcgguga

SEQ ID NO: 20849 - RNA, 1617 nt, Artificial Sequence
  derived and/or modified sequence opt3 from VP1__Norovirus_and/or_Norovirus-like__AB933708
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaaugcugacacagaccacuaagggcgacggcuccacacgcgggcacaaggcuaccguuuacacgggaucagcccccuuuaccccuaaauuggguagcgugcaguucaguacagacacugaaaaugauuuugagacccaucaaaacacaaaguucacuccagucggcgugauccaggacgggucuaccacacaccgaaaugaaccccagcaauggguccucccguccuacagcggaagaaacgugccuaauguucaccuggcaccagccguggcucccaccuuuccuggcgagcaguuacuguucuuuaggucgacuaugcccgguuguucuggguauccaaacauggaucucgacugccuucugccucaggaguggguacagcauuucuaccaagaagcggcacccgcccaguccgaugucgcuuugcuacgguuugugaauccagacacgggccguguucuguucgaguguaaacuccacaagucaggauaugugacagucgcccauaccggccagcacgaucuggugauuccgccuaacggguacuuucgcuucgacaguuggguaaaccaguucuauacucuugcacccaugggaaaugguaccggcagaaggcgguga

SEQ ID NO: 20850 - RNA, 1617 nt, Artificial Sequence
  derived and/or modified sequence opt3 from VP1__Norovirus_and/or_Norovirus-like__LC066046
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauacaaccggcagccacaacuacacgaugaaucucgcaucucagaacugguccaauuaugaucccacugaggaaaucccugcuccacuggguacacccgacuucgucgggaagauacagggagugcuuacccagacuacacggaccgacggcucaacgcgcggccauaaggccaccgucuacacagggagcgcugauuuugccccuaagcugggacgagugcaauucgagacugacaccaaccacgauuuugaagcaaaucagaacacaaaauucacuccaguuggugugauucaggacggcgggaccacacacagaaaugagccccaacaguggguauugccgaguuacucuggaaggaacaccccuaauguccaucucgccccagcuguggcgcccacuuuuccuggcgaacagcuguuauucuuucgguccacgaugcccgguuguagcggguauccaaacauggaucuggacugccuccuuccucaggaguggguucaauacuucuaucaggaggcagcccccgcucagucggauguggcccuguugcguuuugucaauccagacacaggccgcgugcuauucgaauguaagcugcacaaaucuggauacguaaccguggcacauacuggccagcacgaucucguuaucccgccuaacggguauuuuagauucgacuccugggucaaccaauucuacacccuggcccccaugggaaaugguacaggcaggcggcgauga

SEQ ID NO: 20851 - RNA, 1617 nt, Artificial Sequence
  derived and/or modified sequence opt3 from VP1__Norovirus_and/or_Norovirus-like__KJ678140
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauguggucauugacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugaucaugacuuugaaaccaaucagaacacaaaauucacuccaguuggugugauccaggauggcgggaccacacacaggaaugagccccaacaguggguauugccgucuuacuccggacggaacaccccuaauguccaccucgcaccagccguggcucccacuuuuccuggcgaacagcuguuauucuuucguagcacgaugcccgguuguucgggguauccaaacauggaccuggauugccuccuuccucaggaguggguucaauacuucuaucaggaggcggcacccgcccagucugacguggcucuguugcgcuuugucaauccagauacaggcagagugcuauucgaauguaagcugcauaaauccggauacguaaccguggcccacacuggccagcaugaccucguuauuccgccuaacggguauuuuagguucgauucaugggucaaucaauucuacacccuggcacccaugggaaacgguacaggccggcgacgcuga

SEQ ID NO: 20852 - RNA, 1617 nt, Artificial Sequence
  derived and/or modified sequence opt3 from VP1__Norovirus_and/or_Norovirus-like__KJ678139
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugaucaugacuuugaagcaaaucagaacaccaaauucacaccaguuggugugauccaggauggcucuacuacccacaggaaugagccccaacaguggguauugccguccuacagcgggcggaacacaccuaauguccaccucgccccagcuguggcgcccaccuuuccuggagaacagcuguuauucuuucguucgacuaugcccggcuguucugguuauccaaacauggaccuggauugccuccuuccucaggaguggguucaauacuucuaucaggaggcagcccccgcucaguccgacguggcccuguugcgcuuugucaauccagauacggggagagugcuauucgaauguaagcugcauaaaucaggcuacguaacaguggcacacaccggacagcaugaccucguuauuccgccuaacggcuauuuuagguucgauaguugggucaaucaauucuacacucuggcccccauggggaacggaaccggucggcgacgcuga

SEQ ID NO: 20853 - RNA, 1617 nt, Artificial Sequence
  derived and/or modified sequence opt3 from VP1__Norovirus_and/or_Norovirus-like__EU921383
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugaggcacaucaaaacaccaaguucacaccagugggggucauccaggacggaggcacuacccaccgaaaugaaccccagcaaugggugcucccgaguuacucugguagaaacguucacaaugugcaucuggccccugcuguagcgccaacauuucccggggagcaguuacuguucuuuagguccaccaugccuggcuguagcggauaucccaacauggaucucgacugccuucugccacaggaguggguccagcacuucuaccaagaagcagccccugcucagucggauguggccuugcuacgguuuguuaaucccgacacuggccgugugcuguucgaguguaaacuccauaagucuggguaugucacgguggcacacacaggacagcacgaucugguaauuccaccgaacgguuacuuucgcuucgacuccugggugaaccaguucuauacccuugccccuaugggcaaugggacuggaagaaggcgguga

SEQ ID NO: 20854 - RNA, 1617 nt, Artificial Sequence
  derived and/or modified sequence opt3 from VP1__Norovirus_and/or_Norovirus-like__KP176405
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagaauugaaccccuacuuaucccaccuggcccggauguauaauggcuacgcggguggguucgaggugcaggucauucuagcaggaaacgccuuuacagcuggcaaagugaucuucgccgcaguaccuccaaauuuuccgacugagggccucucucccucgcagguuacgauguucccucauauuguggucgaugugcgccaacuggaaccagugcuuaucccccugccugacguccgaaacaauuuuuaucacuacaaccagucaaaugauccaaccauaaaguugaucgcuaugcucuauacaccccugcgugccaacaacgcgggggacgauguuuucacugugagcugcagaguacugaccaggccgaguccugacuuugauuucauuuuucucgugcccccaacagucgagucccggaccaaaccuuucucugugcccguuuuaacuguggaagagaugacaaauagccgcuuuccaaucccccuggagaaacuuuucaccggaccuuccucagccuucgucgugcagccacagaacgguagauguacgacugacggcguauugcuggggaccacacaacuaaguccgguuaauauuugcacuuuuaggggagaugugacccauaucacaggcagccggaacuacaccaugaaucucgcaucucagaacugguccaauuaugaccccacggaagagauaccugcuccacuggguacucccgauuucgucgggaagauucagggagugcuuacacagaccacucgcacagacggcucaacccgaggccacaaggccacggucuacaccgggagcgcugacuuugccccuaagcugggaagagugcaauucgaaacagauacugacagggauuuugaggcaaaccagaauaccaaauucacaccaguuggugugauccaggacggcaguacuacccaucggaacgaaccccaacaguggguauugccgucuuacuccgggcguaauacaccuaacguccaccucgccccagcuguggcgcccaccuuuccuggagagcagcuguuauucuuucgcagcacuaugcccggcuguucggguuauccaaauauggaucuggacugccuccuuccucaggaguggguucaauacuucuaucaggaagcagcccccgcucagucugauguggcccuguugagauuugucaacccagacacggggagggugcuauucgaguguaagcugcacaaauccggcuacguaacaguggcacauaccggacagcacgaucucguuauuccgccuaauggcuauuuucgguucgacucaugggucaaccaauucuacacucuggcccccauggggaacggaaccggucgacgcagauga

SEQ ID NO: 20855 - RNA, 1617 nt, Artificial Sequence
  derived and/or modified sequence opt3 from VP1__Norovirus_and/or_Norovirus-like__KP176403
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccagguucacaccaguuggugugauccaggauggcgggacuacccaccggaaugagccccaacaguggguauugccgagcuacaguggacguaacacaccuaauguccaccucgccccagcuguggcgcccaccuuuccuggcgaacagcuguuauucuuucgcucuacuaugcccgguuguuccggguauccaaacauggaccuggauugccuccuuccucaggaguggguucaacauuucuaccaggaggcagcccccgcucagagcgacguggcccuguugagauuugucaauccagauacgggcagggugcuauucgaauguaaacugcacaagucgggauauguaacaguggcacauaccggccagcacgaccucguuauuccgccuaacggguacuuucgguucgauucuugggucaaccaauucuauacucuggcccccaugggaaaugguaccggccgacgcagauga

SEQ ID NO: 20856 - RNA, 1617 nt, Artificial Sequence
  derived and/or modified sequence opt3 from VP1__Norovirus_and/or_Norovirus-like__KP096343
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccagucccccuggagaaacuuuucaccggaccuuccucagccuucgugguacagccacagaacgguagauguacgacugauggcguuuugcuggggaccacacaacuaaguccggugaauaucugcacuuuuaggggagacgucacccauauuacaggcagccacaacuacaccaugaaucucgcaucucagaacugguccaauuaugaucccacggaggaaaucccugcuccacuggguacucccgacuucguggggaagauacagggaguccuuacacagaccacucggacagacggcucaacccgcggccauaaggccacgguguacaccgggagcgcugauuuugccccuaagcugggacgaguucaauucgagacagacacugauagagacuuugaagcaaaccagaauaccaaauucacaccaguggguguaauucaggauggcgggacuacccacaggaacgagccccaacagugggucuugccgaguuacucuggacggaauacaccuaacgugcaccucgccccagcuguugcgcccaccuuuccuggcgaacagcuguuauucuuucguuccacuaugcccgguuguagcggguauccaaauauggaccuggauugccuccuuccucaggagugggugcaauacuucuaucaggaggcagcccccgcucagucggacgucgcccuguugcgcuuugugaacccagauacgggcagaguacuauucgaauguaagcugcauaaaucuggauacgugacaguugcacacaccggccagcaugaccucgucaucccgccuaauggguauuuuagguucgauuccugggugaaccaauucuacacucuggcccccaugggaaacgguaccggccggcgacgcuga

SEQ ID NO: 20857 - RNA, 1617 nt, Artificial Sequence
  derived and/or modified sequence opt3 from VP1__Norovirus_and/or_Norovirus-like__KM268101
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuugccccuaagcugggacgaauccaauucgagacagacacuaaucacgauuuugaagcaaaccagaauaccaaauucacaccaguggguguuauucaggacggcgggacuacccacagaaacgagccccaacaguggguguugccgagcuacaguggaaggaauacaccuaacguacaucucgccccagcugucgcgcccaccuuuccuggcgaacagcuguuauucuuucggucuacuaugcccgguuguuccggguauccaaauauggaucuggacugccuccuuccucaggagugggugcaauacuucuaucaggaggcagcccccgcucagagcgauguugcccuguugcguuuugugaacccagacacgggccgcguccuauucgaauguaagcugcacaaaucgggauacgugacaguagcacauaccggccagcacgaucucgugaucccgccuaacggguauuuuagauucgacucuuggguuaaucaauucuacacucuggcccccaugggaaacgguaccggcaggcggcgauga

SEQ ID NO: 20858 - RNA, 1617 nt, Artificial Sequence
  derived and/or modified sequence opt3 from VP1__Norovirus_and/or_Norovirus-like__KM198568
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucauugugcagccucagaauggcagauguacuaccgacgggguuuugcugggaacaacucaacuauccccagugaacaucugcaccuuuaggggcggugucacacauauugcagggucacggaauuacaccaugaaccucgcuagucugaauuggaacaauuaugauccgacggaagagauccccgccccucuuggaacuccagacuucgugggcaagauccagggcguacugacacagaccacuaagggggauggaagcacacgcggucacaaggcuaccguuuacacgggcucugcccccuuuaccccuaaauugggguccgugcaguucucaacagacacugaaaacgacuuugaggcacaucaaaauaccaaguucacaccagucggagugauucaggauggcgguacuacccaccgaaacgaaccccagcaauggguccucccgagcuacagugggagagacgugcacaauguucaucuggccccugcuguggcgccaacauuucccggcgagcaguuacuguucuuuaggucuaccaugccuggauguuccggcuaucccaacauggaucucgacugccuucugccacaggaguggguacagcacuucuaccaagaagcagccccugcucagagcgaugucgccuugcuacgguuugugaaucccgacacugggcguguucuguucgaguguaaacuccauaagucgggauaugugacggucgcacacacaggucagcacgaucuggugauaccaccgaacggcuacuuucgcuucgacucuuggguaaaccaguucuauacccuugccccuauggggaauggaacuggcagaaggcgguga

SEQ ID NO: 20859 - RNA, 1617 nt, Artificial Sequence
  derived and/or modified sequence opt3 from VP1__Norovirus_and/or_Norovirus-like__KM198532
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccgugccacuggagaaacuuuucacgggacccagcggugccuucguugugcagccucagaacggcagauguaccacagacggggucuugcugggaacuacccaacuauccccagugaauauaugcacauuuaggggcgauguaacccauauugcagguucacggaacuacacgaugaaucucgcuagucugaacuggaauaacuaugacccgacugaagagauccccgccccucuugggacaccagauuucguuggaaagauucagggcgugcugacccagacuacaaagggcgacgggagcacccgcggacacaaggcuacggucuacaccgguucugcccccuuuacaccuaaauugggcuccgugcaguucucaacugacaccgaaaaugauuuugagacacaucaaaacacuaaguucaccccagucggggugauccaggacggaggcacaacccaccgaaaugaaccccagcaauggguucucccgagcuacagugguagagaugugcacaacguacaucuggccccugcagucgcuccaacuuuucccggggagcaguuacuguucuuuaggucuacgaugccuggcuguuccggauaucccaauauggaccucgauugccuucugccacaggagugggugcagcacuucuaccaagaagcggccccugcacagagcgacguugcuuugcuacgguuugugaaccccgauacaggccguguccuguucgaguguaaacuccauaagucgggguaugugaccguagcccacacuggacagcacgaccuggugaucccaccgaaugguuacuuucgcuucgauucuuggguuaaccaguucuauacccuugcaccuaugggcaacgggacaggaagaaggcgguga

SEQ ID NO: 20860 - RNA, 1617 nt, Artificial Sequence
  derived and/or modified sequence opt3 from VP1__Norovirus_and/or_Norovirus-like__KM198527
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaagcacaacccaccgaaaugaaccccagcaaugggugcucccgaguuacucuggcagagauguucacaacgugcaucuggccccugcaguagcuccaacuuuucccggugagcaguuacuguucuuuagguccacgaugccuggguguagcggcuaucccaauauggaccucgauugccuucugccacaggaguggguccagcacuucuaccaagaagcggccccugcacagucggacguggcuuugcuacgguuuguuaaccccgauacaggacgugugcuguucgaguguaaacuccauaagucuggcuaugucaccguggcccacacugggcagcacgaccugguaauuccaccgaauggauacuuucgcuucgauuccugggugaaccaguucuauacccuugcaccuauggguaacggcacagggagaaggcgguga

SEQ ID NO: 20861 - RNA, 1617 nt, Artificial Sequence
  derived and/or modified sequence opt3 from VP1__Norovirus_and/or_Norovirus-like__KF177448
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaagcgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggaacaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacuacccacaggaacgagccccaacaguggguauugccgucuuacuccgggcggaauacacacaacguccaucucgccccugcuguggcgccaaccuuucccggagaacagcuguuauucuuucguagcacuaugccuggcuguucggguuaucccaauauggaccuggauugccuccuuccacaggaguggguucaauacuucuaucaggaggcagccccugcucagucugacguggcccuguugcgcuuugucaaccccgauacggggagagugcuauucgaauguaagcugcacaaauccggcuacguaacaguggcacauaccggacagcacgaccucguuauuccaccgaauggcuauuuuagguucgauucaugggucaaccaauucuacacucuggccccuauggggaacggaaccggucggcgacgcuga

SEQ ID NO: 20862 - RNA, 1617 nt, Artificial Sequence
  derived and/or modified sequence opt3 from VP1__Norovirus_and/or_Norovirus-like__KF008244
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaaaccaaucagaacacaaaauucacuccaguuggugugauccaggauggcagcaccacacacaggaaugagccccaacaguggguauugccgaguuacucugggcggaacacccacaauguccaucucgccccugcaguggcuccaacuuuucccggagaacagcuguuauucuuucguuccacgaugccuggcuguagcgguuaucccaacauggaccuggauugccuccuuccacaggaguggguucaauacuucuaucaggaggcggccccugcacagucggacguggcucuguugcgcuuugucaaucccgauacagggagagugcuauucgaauguaagcugcacaaaucuggcuacguaaccguggcccauacuggacagcacgaccucguuauuccaccgaacggcuauuuuagguucgauuccugggucaaccaauucuacacccuggcaccuauggggaauggaacaggucggcgacgcuga

SEQ ID NO: 20863 - RNA, 1617 nt, Artificial Sequence
  derived and/or modified sequence opt3 from VP1__Norovirus_and/or_Norovirus-like__KF060103
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucacaacuacaccaugaaucucgccucccagaacuggaacucauaugaucccacggaggaaaucccugcaccacuggguacucccgacuucguugggaagauucagggagugcuuacacagaccacucggacagacggcagcacccgcggccauaaggcuacggucuacaccgggagugccgauuuuucuccuaagcugggacgagugcaauucgcuacagacacugauaaugacuuugagaccaaucagaacacaaaauucacuccagucggugugauccaggauggcgggaccacacacagaaaugaaccccaacaguggguuuugccguccuacagcggaaggaacauccacaaugugcaucucgccccugcaguagccccaaccuuucccggcgagcagcuguuauucuuucggucgacuaugccugguuguucuggguaucccaacauggaccuggauugccuccuuccacaggaauggguccaauacuucuaucaggaggcugcgccugcacaguccgacguggcccuguugcguuuuguuaaucccgauacgggccgcgugcuauucgaguguaagcugcacaaaucaggauacgucacaguggcucauaccggccagcacgaccucguaauuccaccgaacggguauuuuagauucgauaguugggugaaccaauucuacacucuggccccuaugggaaaugguaccggcaggcggcgauga

SEQ ID NO: 20864 - RNA, 1617 nt, Artificial Sequence
  derived and/or modified sequence opt3 from VP1__Norovirus_and/or_Norovirus-like__KC960615
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcgcgucauucuagcaggaaacgccuuuacagcuggcaaaaucauuuucgccgcagugccuccaaauuuuccgacugagggccucucucccucgcagguaacgauguucccucauaucauaguugacgugcgacagcuggagccaguccuuaucccccugccugaugugcguaacaauuuuuaucacuacaaccaaaccaaugacucaacaauuaaguugaucgcuaugcucuauacuccacugagagccaacaacgcgggggaagauguguucaccgucagcugcaggguucugacacggcccaguccggacuuugauuucauuuuucucgugccucccaccguagagucccgcacuaaaccauucacagugccuaucuuaaccgucgaagagaugacuaauucuagauuucccauaccacuggagaaacuuuucacgggacccagcuccgccuucgugguucagccucagaacgguagguguaccacagacggcguguugcuggggacuacccagcuaucaccagucaauauuugcacauuucggggagaugugacccauaucgcaggcagucgcaacuacacgaugaaucucgcuagccugaacuggaauaacuaugacccgacugaagagauucccgccccucuugguacaccagauuucguagggaagauccaaggaguucugacccagacuacaaagggcgacggcucuacccgagggcacaaggcuacgguguacaccggauccgcccccuuuacaccuaaauuggguucaguccaguucagcacugacaccgaaaaugauuuugagauccaucagaacacaaaguucacuccagugggcgucauucaagacgggggaaccacacacagaaaugaaccccagcagugggugcucccgaguuacucuggcagggauguucacaacgugcaucuggccccugcaguagcuccaaccuuucccggugagcaauuacuguucuuucgguccacuaugccuggguguagcggcuaucccaauauggaccucgauugccuucugccacaggaguggguccagcacuucuaccaggaagcggccccugcacaaucggacguggcuuugcuacguuuuguuaaccccgauacgggacgcgugcuguucgaguguaaacuccauaagucuggcuaugucacaguggcccacaccgggcagcacgaccugguaauaccaccgaauggauacuuuagauucgauuccugggugaaccaguucuauacucuugcaccuauggguaacggcaccgggaggcggcgauga

SEQ ID NO: 20865 - RNA, 1617 nt, Artificial Sequence
  derived and/or modified sequence opt3 from VP1__Norovirus_and/or_Norovirus-like__KC517373
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucuggauuucccauaccacuggagaaacuuuucacgggucccagcuccgccuucgugguucagccucagaauggccgcuguacuaccgacgggguguugcugggaacaacucaacuaucaccagucaacauuugcaccuuuagaggcgaugugacacauaucgcagguaguaggaauuacaccaugaaccucgcuagccugaauuggaacaauuaugacccgacggaagagauucccgccccucuugggacuccagauuucguaggaaagguucagggcgugcugacacagaccacuaagggcgacgggucuacacggggacacaaggcuaccgucuacacggguuccgcccccuuuaccccuaaauugggcucagugcaguucgaaacagacacugagaacgauuuugaaacccaucaaaauacaaaguucacuccagucggggugauccaggacggaggcaccgcacaccgcaacgagccccagcaauggguucucccgagcuacaguggucgaaaugugccuaacguacaccuggccccagcugucgcgcccacauuuccuggggagcaguuacuguucuuuagaucuaccaugcccggcuguuccggauauccaaauauggaucucgacugccuucugccucaggaaugggugcagcauuucuaccaagaggcagcccccgcucagagcgauguugccuugcuaagguuugugaacccagacacuggccggguccuguucgaauguaaacuccacaagucgggguaugugacgguagcacauacaggacagcgugaucuggugaucccgccuaacgguuacuuucgcuucgacucuuggguuaaucaguucuauacccuugcccccaugggcaacgggacuggaagaaggcgguga

SEQ ID NO: 20866 - RNA, 1617 nt, Artificial Sequence
  derived and/or modified sequence opt3 from VP1__Norovirus_and/or_Norovirus-like__JX459615
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggaguuugacuucauuuuucucgugccucccacaguagaaucccggaccaaaccauucacugugccuaucuuaacagucgaggagaugaccaacucucgcuuucccauaccacuggaaaaacuuuucacgggacccagcggugccuucgugguucagccucagaauggcagauguacuaccgaugggguguugcugggaacaacucaacuauccccagucaacauuugcaccuuuaggggcgacgugacacauaucgcagguucacggaauuacaccaugaaccucgcuagucugaauuggaacaauuaugauccgacggaggaaauucccgccccucuugggacuccagacuucguaggaaagauccagggcguucugacacagaccacuaagggcgaugggagcacacgcggacacaaggcuaccguguacacggguucugcccccuuuaccccuaaauugggcuccguccaguucucaacagacacugagaacgacuuugaaacccaucaaaauacaaaguucacuccagugggggucauccaggauggaggcaccacacaccgaaacgagccccagcaaugggugcucccgagcuacagugguagaaauguucacaacgugcaucuggccccugcaguagcuccaaccuuucccggggagcaguuacuguucuuuaggucuacuaugccuggcuguuccggauaucccaauauggaccucgauugccuucugccacaggaauggguccagcacuucuaccaagaggcggccccugcacagagcgacguggcuuugcuacgguuuguuaaccccgauacgggccgugugcuguucgaauguaaacuccauaagucgggguaugucacaguggcccacaccggacagcacgaccugguaauuccaccgaacgguuacuuucgcuucgauucuugggugaaucaguucuauacucuugcaccuaugggcaacgggaccggaagaaggcgguga

SEQ ID NO: 20867 - RNA, 1617 nt, Artificial Sequence
  derived and/or modified sequence opt3 from VP1__Norovirus_and/or_Norovirus-like__JX459603
augaagauggccagcaacgacgcuacccccuccgauggcguggcagcccaccuggucccugagguuaauaacgaagugauggcgcucgagccaguagugggggcugccaucgcagccccggucgcuggacagcaaaaugugauugaccccuggauaagaaacaauuucguucaggcaccugguggcgaauuuacagugucuccaaggaacgcccccggggagauccuuuggucagcuccucugggaccagauuugaaucccuacuuaagucaucuggcccggauguauaacggcuacgcggguggguucgaaguccaggugauucuagcaggaaaugccuuuacugcuggcaaaaucauuuucgccgcaguaccuccaaacuuuccgacggagggccucagccccucccagguuaccauguucccucacaucauaguggacguccgccaacuggagccagugcuuaucccccugccugaugugcgaaauaacuuuuaucauuacaaucagucuaacgacucgacaauuaaguugaucgcuaugcucuauacuccacugcgugccaauaacgcgggggaagaugucuucaccguuucaugcagagugcugacaaggcccagcccggacuuugauuucauuuuucucguaccucccaccguggagagucggacuaaaccauucacagucccuaucuuaaccguggaagagaugacgaacucccgcuuucccauaccacuggagaaacuuuucacuggacccucuggugccuucguugugcagccucagaauggcagauguaccacagacggggucuugcugggaacuacccaacuaagcccagugaacauuugcacauuuaggggcgauguaacccacaucgcagguucccggaauuacacgaugaaccucgcuucacugaauuggaacaauuaugacccgacugaagagauucccgccccucuugggacaccagauuucguuggaaagauccagggcgugcugacccagacuacaaagggcgacgggaguacccgcggacauaaggcuacggucuacaccgguagcgcccccuuuacaccuaaauugggcucugugcaguucuccacugacaccgaaaacgauuuugagacacaccaaaauacuaaguucaccccagucggggugauccaggacggaggcacaacccaccgaaacgaaccccagcaauggguucucccgucauacagcgguagaaaugugcauaacguacaccuggccccugcagucgcuccaacuuuucccggggagcaguuacuguucuuuaggaguacgaugccuggcuguucuggauaucccaauauggaucucgacugccuucugccacaggagugggugcagcauuucuaccaagaagcggccccugcacaguccgauguugcuuugcuacgguuugugaaccccgacacaggccguguccuguucgaguguaaacuccacaagagcggguaugugaccguagcccacacuggacagcaugaucuggugauuccaccgaaugguuacuuucgcuucgacucguggguuaaccaguucuauacccuugcaccuaugggcaacgggacaggaagaaggcgguga

SEQ ID NO: 20868 - RNA, 1617 nt, Artificial Sequence
  derived and/or modified sequence opt3 from VP1__Norovirus_and/or_Norovirus-like__JX155746
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagaaaugugccuaacguucaccuggcaccagccguggcucccaccuuuccuggcgagcaguuacuguucuuuaggagcacuaugcccgguuguucgggguauccaaauauggaucucgacugccuucugccucaggaguggguacagcauuucuaccaagaagcggcacccgcccagucugaugucgcuuugcuacgguuugugaacccagacacgggccguguucuguucgaguguaaacuccacaagccgggauaugugacagucgcccauaccggccagcacgaucuggugauuccucccaacggguacuuucgcuucgacuccuggguaaaucaguucuauacucuugcaccaaugggaaacgguaccggcagaaggcgguga

SEQ ID NO: 20869 - RNA, 1617 nt, Artificial Sequence
  derived and/or modified sequence opt3 from VP1__Norovirus_and/or_Norovirus-like__AB541333
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucuggauccagacuugaaucccuacuuaagccagcuggcccggauguauaacggauacgcgggcgguuucgaagugcaggucauucuagcagggaaugccuuuacagcuggaaaaaucauuuucgccgcagugccuccaaacuuuccgacugagggccucucccccucucaaguaacgauguucccucacaucauaguugaugugcgccagcuggagccaguccuuaucccccugccugacgugcgaaauaacuuuuaucauuacaaucagucgaacgauucaaccauuaaguugaucgcuaugcucuauacaccacugcgugccaacaaugcgggcgaagacguguucacugucagcugcagaguucugaccaggcccaguccggauuuugacuucauuuuucucgugccucccacaguagagucccggaccaaaccauucacugugccuaucuuaacagucgaagagaugaccaacucucgcuuucccauaccacuggagaaacuuuucacggggcccagcuccgccuucgugguucagccucaaaauggaagauguacuaccgaugguguguugcugggcacaacucagcuaucaccagucaacauuugcaccuuuaggggagacgugacacacaucgcagggagucggaauuacaccaugaaccucgcuagccugaauuggaacaauuaugauccgacggaagagauucccgccccucuuggcacuccagacuucguagguaagauccaggggguucugacacagaccacuaagggagacggcucuacacgcggccauaaggcuaccguguacacgggguccgcccccuuuaccccuaaauugggaucaguccaauucagcacagauacugaaaacgacuuugagacccaccagaauacaaaguucacuccagugggugucauccaggauggcgggaccacacaucgaaacgaaccccaacagugggugcucccgaguuacucuggaagaaauguuccuaacgugcaccuggcaccagccguagcucccaccuuuccuggcgagcaguuacuguucuuuagguccacuaugcccgguuguagcggguauccaaauauggaccucgauugccuucugccucaggaguggguccaacacuucuaccaggaagcggcacccgcccagucggacguggcuuugcuacgguuuguuaacccagauacgggccgugugcuguucgaguguaaacuccauaagucuggauaugucacaguggcccacaccggccagcaugaccugguaauuccgccuaacggguacuuucgcuucgauuccugggugaaucaauucuauacucuugcacccaugggaaacgguaccggcagaaggcgguga

SEQ ID NO: 20870 - RNA, 1617 nt, Artificial Sequence
  derived and/or modified sequence opt3 from VP1__Norovirus_and/or_Norovirus-like__AB541220
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacucuauaagucuggcuacgucacaguggcccacaccgggcagcaugaucugguaauuccgccuaacggauauuuucgcuucgacuccugggugaaucaguucuacacucuugcacccauggguaacggcaccgggagaaggcgguga

SEQ ID NO: 20871 - RNA, 1617 nt, Artificial Sequence
  derived and/or modified sequence opt3 from VP1__Norovirus_and/or_Norovirus-like__AB504312
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacucaacuauuaaguugaucgcaaugcucuauaccccacugcgugcuaacaacgccggggaugacguguucacagucagcugcagaguucugaccaggcccaguccggauuuugacuucauuuuucucgugccucccacuguagaaucccggacaaaaccauucucugugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucgccggcacgcagaacuacacuaugaaucucgcaagccagaacuggaauaacuaugauccgacagaggaaauucccgcuccucuggguaccccagacuucguagggaagauccagggaguucuuacucaaacaacccggcgcgacggcucuacgcgaggccacaaggccaccguguccacagggucaguccauuuuacucccaagcugggaagcgugcaguucaguaccgauacaucuaaugacuuugagacuggucagaacaccagauucacaccugucggcgugguucaagauggguccaccacucaccagaaugaaccacagcaguggguguugcccaacuacagcggaagggacucgcacaauguacaucucgcuccggccgucgcaccuacguuuccaggcgagcaacuguuauucuuucggucuacaaugcccgguuguuccggguacccuaacaugaaucuggauugccuccuuccccaggaaugggugcagcacuucuaucaggagucagccccagcucaaagugacguugcgcuguugcguuuugugaacccugauaccggccgcguccuauucgagugugaacugcauaaaagcggauacgugacuguagcacacaccggccagcacgaccucgugauucccccaaacggguauuuuagauucgauuccuggguuaaucaguucuacacacuggccccgaugggaaacggugcuggcaggcggcgauga

SEQ ID NO: 20872 - RNA, 1617 nt, Artificial Sequence
  derived and/or modified sequence opt3 from VP1__Norovirus_and/or_Norovirus-like__GQ849126
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucguuguggacguccgccaacuggagccagugcuuauaccccugccugaugugcgaaacaauuuuuaucacuacaaccagagcaaugacccaacaaucaaguugauugcaaugcucuauacuccccugcgugcuaacaacgccggcgaugacgucuucaccguuaguugcagagugcugacaaggccguccccugauuuugacuucaucuuucucguacccccaaccguggaaucucggacuaaaccuuucagcguccccauuuuaacaguggaggaaaugaccaauucccgcuuuccaaucccccuggagaaacuuuucacggggccuucaagugcguucguugugcagccacagaacggaagauguacuaccgauggugucuugcugggcacaacucaacuaagcccggugaauauaugcaccuuuagggggaacguaacacauauugccggaacccaggaguacacgaugaaucucgcaucucagaacuggaauaacuaugaccccacugaagagaucccugcuccacugggcacacccgauuucguugguaagauucagggggugcuuacccaaacuacacggcgcgacggauccacccgaggccacaaggccacggucucaaccggcagcgugcauuuuacaccuaagcuggggagaauccaguucaguacugacaccucuaaugauuuugaaacaggacagaacacuagguucaccccagucggugugguucaagacggcuccacaacccaccagaaugagccccagcaguggguguugccgaacuacagcgggcgggauucgcacaauguacaucucgcuccugccgucgcaccaucuuuucccggagaacaacuguuauucuuucguuccacuaugccuggcuguucagguuaccccaacaugaaucuggacugccuccuuccacaggagugggugcagcacuucuaucaggaggccgcuccugcgcaaagugauguugcacuguugcgcuuugugaaccccgacacggggagaguccuauucgaauguaaacugcauaagagcggcuacgugacaguagcccacaccggacagcacgaucucgugaucccaccgaacggcuauuuuagguucgacuccuggguuaaucaguucuacacucuggcuccuauggggaacggaaccggucggcgacgcuga

SEQ ID NO: 20873 - RNA, 1617 nt, Artificial Sequence
  derived and/or modified sequence opt3 from VP1__Norovirus_and/or_Norovirus-like__AB447459
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggccuguugacacagaccacuaagggcgacgggagcacacgcggacacaaggcuaccguuuacacggguucugcccccuuuaccccuaaacucggcuccgugcaguucucaacagacacugaaaacgauuuugagacccaucaaaauacaaaguucacuccagucggggugauccaggacggaagcaccacacaccgaaacgaaccccagcaauggguccugccgaguuacucuggcagaaaugugcacaacguucauuuagccccugcaguggcuccaaccuuucccggugagcagcugauuuucuuuagguccacuaugccuggguguagcggcuaucccaauauggaucucgacugccuucugccacaggaguggguacagcacuucuaccaagaagcggccccugcacagucggaugucgcuuugcuacgguuugugaaccccgacacgggacguguucuguucgaguguaaacuccauaagucuggcuaugugacagucgcccacaccgggcagcacgaucuggugauaccaccgaacggauacuuucgcuucgacuccuggguaaaucaguucuauacucuugcaccuauggguaacggcaccgggagaaggcgguga

SEQ ID NO: 20874 - RNA, 1617 nt, Artificial Sequence
  derived and/or modified sequence opt3 from VP1__Norovirus_and/or_Norovirus-like__EU078413
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugacgaacucucgcuuucccauaccacuggagaaacuuuucacuggacccagcggugcguucgugguucagccucagaauggcagauguaccacagaugggguguugcugggaacuacccaacuauccccagucaacauuugcacauuuaggggcgacgugacccauaucgccgguacgcggaauuacacuaugaaccucgcaucacagaauuggaacaauuaugauccgacagaggaaauucccgcuccucuggggaccccagacuucguaggacgcauccagggcaugcuuacucagacaacccgaagagacggcaguacgagggggcacaaggccaccguuagcacaggagaugcucauuuuacucccaagcuggguucuaucauguucuccaccgacacagauaacgacuuugagacuggccaaaauaccaaguucacaccugugggggucgugcaggauggaaacggcacccaccagaaugaaccacaacagugggucuugcccucauacagcggucggacugggcacaacgugcaucucgccccggcaguugccccuacguuuccaggcgagcagcuguuauucuuucguaguacaaugcccggauguucuggcuacccuaauaugaaccuggacugccuccuuccccaggaaugggugcaacacuucuaucaggaggcugcgccagcacaguccgauguagcccuguugcgcuuugucaacccugacaccgggagagugcuauucgaguguaaacugcauaagagcggauacguuacuguggcucacaccggucagcacgaucucgucauucccccaaauggcuauuuuagguucgacucgugggugaaccaauucuacacacuggccccgauggggaauggaaccggccggcgacgcuga

SEQ ID NO: 20875 - RNA, 1617 nt, Artificial Sequence
  derived and/or modified sequence opt3 from VP1__Norovirus_and/or_Norovirus-like__EU078411
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucacagugcccaucuuaaccgucgaggaaaugacuaauucucgcuuuccaauaccccuggagaaacuuuucacgggaccuagcuccgcguucgugguucagccacagaacgguagauguaccacagauggcguguugcuggggacuacccaacuaucaccggucaauauuugcacauuuaggggagacgugacccauauccccggcacgcggacuuaccgcaugaaccucgccagucagaauuggaacaauuaugauccuacagaggaaauuccagcaccccuggguaccccugacuucguagggaagauccagggaaugcuuacucagacaaccaagggcgacggcagcacgcgagggcacaaggcuaccguuucuacaggauccguggauuuuacuccaaaacuggguucaguccaauucgccaccgacacagauaacgacuuugagacuggccagaauaccagauucacacccgugggggucauccaggauggaagcagugcucauaggaacgaaccgcaacaguggguguugccugacuacucuggccggaccguucacaaugugcaccucgccccagcaguagcccccacuuuuccuggugagcagcuguuauucuuucguuccacgaugcccggguguagcggcuacccaaacauggaucuggacugccuccuuccucaggaauggguccaacauuucuaucaggaggcugcgcccgcacagucggauguggcccuguugcgcuuuguuaauccagacacaggaagagugcuauucgaguguaagcugcacaaaaccggcuacgucacuguggcucauaccgggcagcacgaucucguaauuccgccuaacggauauuuuagguucgacucuugggugaaucaauucuacacacuggcccccauggguaacggcgcagggcggcgacgcuga

SEQ ID NO: 20876 - RNA, 1617 nt, Artificial Sequence
  derived and/or modified sequence opt3 from VP1__Norovirus_and/or_Norovirus-like__AB385632
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucguguucgcugccguaccuccaaauuuuccgacggagggccucucgcccucacagguuaccauguucccucauauuaucguggacguccgccaacuggagccagugcuuauaccccugccugaugugcgaaacaauuuuuaucacuacaaccagagcaaugacccaacaaucaaguugauugcaaugcucuauacuccccugcgugcuaacaacgccggcgaugacgucuucaccguuaguugcagagugcugacaaggccguccccugauuuugacuucaucuuucucguacccccaaccguggaaucucggacuaaaccuuucagcguccccauuuuaacaguggaggaaaugaccaauucccgcuuuccaaucccccuggagagacuuuucacggggccuucaagugcguucguugugcagccacagaacggaagguguacuaccgauggugucuugcugggcacaacucaacuaagcccggugaauauaugcaccuuucgcggggacguaacacauauugccggaacccaggaguacacgaugaaccucgcaucucagaauuggaacaauuaugaucccacugaagagguuccugcuccacugggcacacccgacuucauggguaagauccagggggugcuuacccaaacuacacggcgagacggauccaccagaggccacaaagccacggucucaaccggcagcgugcauuuuacaccuaagcuggggaggauucaguucaguacugauaccucuaacgacuuugaaacaggacagaauacucgguucaccccagucggugugguucaagauggcuccacaacccaccagaacgagccccagcaguggguguugccgaauuacagcgggcgugacucgcacaacguacaucucgcuccugccgucgcaccaucuuuucccggagaacaacuguuauucuuucgcuccacuaugccuggcuguucagguuaccccaauaugaaccuggauugccuccuuccacaggagugggugcagcacuucuaucaggaggccgcuccugcgcaaagugacguugcacuguugagauuugugagccccgauacggggaggguccuauucgaauguaagcugcauaaauccggcuacgugacaguagcccacaccggacagcacgaccucgugaucccaccgaauggcuauuuucgguucgauucuuggguuaaccaguucuacacucuggcuccuauggggaacggaaccggucgacgcagauga

SEQ ID NO: 20877 - RNA, 1617 nt, Artificial Sequence
  derived and/or modified sequence opt3 from VP1__Norovirus_and/or_Norovirus-like__EU839595
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccgggauuugacuucauuuuucucgugccucccacaguagagucccggaccaaaccauucacugugccuaucuuaacagucgaagagaugaccaacucucgcuuucccauaccacuggagaaacuuuucacgggucccagcuccgccuucgugguucagccucagaauggcagauguacuaccgaugggguguugcugggaacaacucaacuaucaccagucaacauuugcaccuuuaggggcgacgugacacauaucgcagguagucggaauuacaccaugaaccucgcuagccugaauuggaacaauuaugauccgacggaagagauucccgccccucuugggacuccagacuucguaggaaagauccagggcguucugacacagaccacuaagggcgaugggucuacacgcggacacaaggcuaccguguacacggguuccgcccccuuuaccccuaaauugggcucaguccaguucagcacagacacugaaaacgacuuugagacccaucaaaauacaaaguucacuccagugggggucauccaggauggaggcaccacacaccgaaacgaaccccagcaaugggugcucccgaguuacucugguagaaauguuccuaacgugcaccuggcaccagccguagcucccaccuuuccuggggagcaguuacuguucuuuagguccacuaugcccggcuguagcggauauccaaauauggaccucgauugccuucugccucaggaguggguccagcauuucuaccaagaagcggcacccgcccagucggacguggcuuugcuacgguuuguuaacccagauacgggccgugugcuguucgaguguaaacuccacaagucuggguaugucacaguggcccauaccggacagcacgaccugguaauuccgccuaacgguuacuuucgcuucgauuccugggugaaucaguucuauacucuugcacccaugggcaacgggaccggaagaaggcgguga

SEQ ID NO: 20878 - RNA, 1617 nt, Artificial Sequence
  derived and/or modified sequence opt3 from VP1__Norovirus_and/or_Norovirus-like__AB294788
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacucaacuauuaaguugaucgcaaugcucuauaccccacugcgugcuaacaacgccggggaugacguguucacagucagcugcagaguucugaccaggcccaguccggauuuugacuucauuuuucucgugccucccacuguagaaucccggacaaaaccauucucugugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucgccggcacgcagaacuacacuaugaaucucgcaagccagaacuggaauaacuaugauccgacagaggaaauucccgcuccucuggguaccccagacuucguagggaagauccagggaguucuuacucaaacaaccacgcgggacggcucuacccgcggccacaaggccacaguguccacugggucaguccauuuuacccccaagcugggaagcgugcaguucaguacagauacuucuaaugacuuugagaccggucagaacacacgauucaccccugucggcgugguucaagauggguccacuacgcaccagaaugaaccacagcaguggguguugcccgacuacagcggaagagauucgcacaacguacaucucgcuccggccgucgcaccuacauuuccaggcgagcaacuguuauucuuuaggucuaccaugcccgguuguuccggguacccuaauaugaaccuggacugccuccuuccccaggaaugggugcagcacuucuaucaggagucagccccagcucaaagugauguugcgcuguugcgguuugugaauccugacacuggccguguccuauucgaguguaaacugcauaagagcggauacgugaccguagcacacacaggccagcacgaucucgugauucccccaaacggguauuuucgcuucgacuccuggguuaaccaguucuacacccuggccccgaugggaaauggugcuggcagaaggcgguga

SEQ ID NO: 20879 - RNA, 1617 nt, Artificial Sequence
  derived and/or modified sequence opt3 from VP1__Norovirus_and/or_Norovirus-like__AB303936
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccauccuuuccgaccgagggccucucucccucgcagguaacaauguucccucauaucauaguugacgugcgccaacuggagccaguccuuaucccccugccugaugugcgaaauaacuuuuaucacuacaaucagucaaacgacccaacuauuaaguugaucgcaaugcucuauaccccucugcgugcuaauaacgccggggaagauguguucacagucagcugcagaguucugaccaggccgaguccugacuuugauuucauuuuucucgugcccccaacuguagagucccggacaaaaccuuucaccgugcccaucuuaacggucgaagagaugacuaacucucgcuuuccaauaccccuggagaaacuuuucaccggaccuagcggugcguucgugguucagccacagaauggcagauguacaacugacgggguguugcugggaaccacacaacuauccccggucaacauuugcaccuuuaggggcgaugugacgcauaucgccgguacucacaauuacacaaugaaccucgcaucacagaauuggaacaauuaugaccccaccgaagagauuccugcuccacuggggacucccgauuucguaggacggauccagggcaugcuuacacagaccacgcgcggcgacgggaguacccgaggacauaaggccacaguuagcacuggugacgugcacuuuaccccuaagcugggcucuguccaauucgauacagacacuaacuccgauuuugaaaccgggcagaauacaaaguucaccccagugggagucgugcaggacggcaacggugcucaccaaaaugagccccagcaguggguuuugccgucauacagcgggagaacuggccauaacgcccaccucgcacccgccguggcuccaacguuucccggagaacagcuguuauucuuuaggaguacaaugccuggcuguucuggguaccccaauaugaaccuggauugccuccuuccacaagaguggguacagcauuucuaucaggaggcggccccugcacaguccgacgucgcucuguugcgguuugugaaucccgauaccggacguguucuauucgaauguaaacugcacaagagcgguuacgugacugucgcccacaccggccaacaugaccucgugaucccaccgaacggguauuuucgcuucgauucguggguaaaccaguucuacacacuggcaccuaugggaaauggcaccgguagaaggcgguga

SEQ ID NO: 20880 - RNA, 1617 nt, Artificial Sequence
  derived and/or modified sequence opt3 from VP1__Norovirus_and/or_Norovirus-like__AB303935
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccauccuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaagauguguucaccgucagcugcagaguucugacaaggccgaguccugacuuugauuucauuuuucucgugcccccaaccguagagucccggacuaaaccuuucacagugcccaucuuaaccgucgaagagaugacuaauucucgcuuuccaauaccccuggagaaacuuuucacgggaccuagcggugcguucgugguucagccacagaacggcagauguaccacagacgggguguugcugggaacuacccaacuauccccggucaauauuugcacauuuaggggcgaugugacccauaucgccgguacgcacaacuacacuaugaaucucgcaucacagaacuggaauaacuaugaccccacagaagagauuccugcuccacuggggacccccgauuucguaggacggauccagggcaugcuuacucagacaacccgcggcgacgggaguacgcgaggacauaaggccaccguuagcacaggugacgugcacuuuacuccuaagcugggcucuauccaauucaauaccgauacaaacaaugacuuugaaacugggcagaacaccaaguucacaccagucggagugguccaggauggcaaugguacccaccaaaacgagccccagcaguggguguugccguccuacucagggagaacuggccauaauguucaccucgcuccugccguggcaccaacguuucccggagaacagcuguuauucuuuaggagcacaaugccuggcuguaguggguaccccaacaugaaccuggacugccuccuuccacaagaguggguacagcauuucuaucaggaggccgcuccugcgcagucugaugucgcacuguugcgguuugugaaucccgacaccggacguguucuauucgaauguaaacugcacaaguccgguuacgugacugucgcccacaccggccaacaugaucucgugauuccaccgaacggguauuuucgcuucgacagcuggguaaaucaguucuacacacuggcuccuaugggaaacggcaccgguagaaggcgguga

SEQ ID NO: 20881 - RNA, 1617 nt, Artificial Sequence
  derived and/or modified sequence opt3 from VP1__Norovirus_and/or_Norovirus-like__AY588018
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcguccaauucaacaccgauacaaauaacgacuuugaaacugggcagaauaccaaguucacaccagugggagucgugcaggauggcaacggugcucaccaaaaugagccccagcaguggguuuugccgucuuacuccgggagaaccggccauaacgugcaccucgccccugcaguagccccaacuuuucccggagaacagcuguuauucuuuaggucaacgaugccuggcuguagcggguaccccaacaugaaucuggacugccuccuuccacaagaguggguccagcauuucuaucaggaggcugcgccugcacagagugauguggcccuguugcgguuuguuaaccccgacacaggacgugugcuauucgaauguaaacugcacaagucugguuacgucaccguggcucacacuggccaacaugaucucguaaucccaccgaauggguauuuucgcuucgacuccugggugaaccaguucuacacccuggccccuaugggaaauggcacagguagaaggcgguga

SEQ ID NO: 20882 - RNA, 1617 nt, Artificial Sequence
  derived and/or modified sequence opt3 from VP1__Norovirus_and/or_Norovirus-like__KU678203
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacuaaccacgauuuugaagcaaaucagaacaccaaauucacaccaguuggugugauccaggacggcgggacuacccacagaaaugagccccaacaguggguauugccgaguuacucuggaaggaacacaccuaauguccaucucgccccagcuguggcgcccaccuuuccuggcgaacagcuguuauucuuucgguccacuaugcccgguuguagcggguauccaaacauggaucuggacugccuccuuccucaggaguggguucaauacuucuaucaggaggcagcccccgcucagucggauguggcccuguugcguuuugucaauccagacacgggccgcgugcuauucgaauguaagcugcacaaaucuggauacguaacaguggcacauaccggccagcacgaucucguuauuccgccuaacggguauuuuagauucgacuccugggucaaccaauucuacacucuggcccccaugggaaaugguaccggcaggcggcgauga

SEQ ID NO: 20883 - RNA, 1617 nt, Artificial Sequence
  derived and/or modified sequence opt3 from VP1__Norovirus_and/or_Norovirus-like__KP176410
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcgggacuacccaucggaacgagccccaacaguggguauugccgaguuacucuggacguaauacaccuaacguccaccucgccccagcuguggcgcccaccuuuccuggcgaacagcuguuauucuuucgcuccacuaugcccgguuguagcggguauccaaauacggaccuggauugccuccuuccucaggaguggguucaauacuucuaucaggaggcagcccccgcucagucggacguggcccuguugagauuugucaacccagauacaggcagggugcuauucgaauguaagcugcacaaaucuggauacguaaccguggcacauacuggccagcacgaccucguuauuccgccuaauggguauuuucgguucgauuccugggucaaccaauucuacacccuggcccccaugggaaacgguacaggccgacgcagauga

SEQ ID NO: 20884 - RNA, 1617 nt, Artificial Sequence
  derived and/or modified sequence opt3 from VP1__Norovirus_and/or_Norovirus-like__KX371609
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacucgcggcgacggcucuacacgagggcacaaggcuaccguuuacacgggauccgcccccuuuaccccuaaguuggguucagugcaguucgaaacagacacugagaacgauuuugaaacccaucaaaauacaaaauucacuccagucggcgugauccaggacgggggaaccacacacagaaacgagccccagcaauggguccucccgagcuacaguggcaggaaugugccuaacguucaccuggcaccagccguggcucccaccuuuccuggugagcaguuacuguucuuucggucuacuaugcccggguguuccggcuauccaaauauggaucucgacugccuucugccucaggaauggguacagcauuucuaccaagaggcggcacccgcccagagcgaugucgcuuugcuacguuuugugaacccagacacgggacgcguucuguucgaauguaagcuccacaaaucgggcuaugugacagucgcccauaccgggcagcacgaucuggugauuccgccuaacggauacuuuagauucgacucuuggguaaaucaguucuauacucuugcacccauggguaacggcaccgggaggcggcgauga

SEQ ID NO: 20885 - RNA, 1617 nt, Artificial Sequence
  derived and/or modified sequence opt3 from VP1__Norovirus_and/or_Norovirus-like__KX354130
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagagacuuuucaccggaccuuccucagccuucgucgugcagccacagaacgguagguguacgacugauggcguauugcuggggaccacacaacuaaguccgguuaauauuugcacuuuucggggagacaucacccauauaacaggcagccacaacuacaccaugaaucucgcaucucagaacuggaauaacuaugaucccacggaggaaauuccugcuccacuggguacucccgacuucguggggaagauccagggaguccuuacacagaccacucgcacagacggcuccacccgaggccauaaagccacgguguacaccgggucagcugaguuugccccuaagcugggaagaguccaauucgaaacagauacuaaucacgacuuugaggcaaaccagaauaccaaguucacaccaguggguguuauucaggauggcagcacuacccacaggaacgaaccccaacaguggguguugccgaguuacucugggcggaauacacauaacguacaccucgccccugcugucgcgccaaccuuucccggagagcagcuguuauucuuucguuccacuaugccuggcuguagcgguuaucccaauauggaccuggauugccuccuuccacaggagugggugcaauacuucuaucaggaagcagccccugcucagucggacguugcccuguugcgcuuugugaaccccgauacggggagaguccuauucgaguguaaacugcauaagucuggcuacaucacaguggcacacaccggacagcacgaccucguaaucccaccgaacggcuauuuuagguucgauuccugggugaaucaauucuacacucuggccccuauggggaacggaaccggucggaaacgauga

SEQ ID NO: 20886 - RNA, 1617 nt, Artificial Sequence
  derived and/or modified sequence opt3 from VP1__Norovirus_and/or_Norovirus-like__KX354120
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggaaugcuuacacagaccacucgcacagacggcucaacccgaggccacaaggccacgguguacaccgggagcgcugauuuugccccuaagcugggaagaguccaauucgagacagacacugaucaugacuuugaagugaaccagaauaccaaauucacaccaguuggugugauccaggauggcaguacuacccacaggaacgagccccaacaguggguauugccgucuuacuccgggcggaauacaccuaacguccaccucgcaccagccguggcucccaccuuuccuggagaacagcuguuauucuuucguagcacuaugcccggcuguucggguuauccaaauauggaccuggauugccuccuuccucaggaguggguucaauacuucuaucaggaggcggcacccgcccagucugacguggcucuguugcgcuuugucaacccagauacggggagagugcuauucgaauguaagcugcauaaauccggcuacguaacaguggcccacaccggacagcaugaccucguuauuccgccuaauggcuauuuuagguucgauucaugggucaaccaauucuacacucuggcacccauggggaacggaaccggucggcgacgcuga

SEQ ID NO: 20887 - RNA, 1617 nt, Artificial Sequence
  derived and/or modified sequence opt3 from VP1__Norovirus_and/or_Norovirus-like__KX354113
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagagacuuuucaccggaccuucaagugccuucgucgugcagccacagaaugguagguguacgacugauggcguauugcuggggaccacacaacuaagcccgguuaacauuugcacuuuucggggagacgugacccauaucacaggcucucgcaauuacaccaugaaccucgcaucccagaauuggucaaacuaugaucccacggaggaaauaccugcuccacuggguacucccgacuucgucgggaagauucagggagugcuuacacagaccacucgaacagacggcagcaccagaggccacaaagccacggucuacaccgggagugcugauuuugccccuaagcugggaagggugcaauucgagacagacacugaucaugacuuugaagcaaaucagaacaccaaguucacaccaguuggugugauccaggauggcgggacuacccaccggaaugagccccaacaguggguauugccgucuuacuccggacguaacacaccuaauguccaccucgccccagcuguggcgcccaccuuuccuggcgaacagcuguuauucuuucgcagcacuaugcccgguuguucgggguauccaaacauggaccuggauugccuccuuccucaggaguggguucaauacuucuaucaggaggcagcccccgcucagucugacguggcccuguugagauuugucaauccagauacgggcagggugcuauucgaauguaaacugcauaaguccggauacguaacaguggcacacaccggccagcaugaccucguuauuccgccuaacggguauuuucgguucgauucaugggucaaucaauucuacacucuggcccccaugggaaacgguaccggccgacgcagauga

SEQ ID NO: 20888 - RNA, 1617 nt, Artificial Sequence
  derived and/or modified sequence opt3 from VP1__Norovirus_and/or_Norovirus-like__KX354105
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcaguacuacccaucggaacgagccccaacaguggguauugccgucuuacuccgggcguaauacaccuaacguccaccucgccccagcuguggcgcccaccuuuccuggagaacagcuguuauucuuucgcagcacuaugcccggcuguucggguuauccaaauauggaccuggauugccuccuuccucaggaguggguucaauacuucuaucaggaggcagcccccgcucagucugacguggcccuguugagauuugucaacccagauacggggagggugcuauucgaauguaagcugcacaaauccggcuacguaacaguggcacauaccggacagcacgaccucguuauuccgccuaauggcuauuuucgguucgauucaugggucaaccaauucuacacucuggcccccauggggaacggaaccggucgacgcagauga

SEQ ID NO: 20889 - RNA, 1617 nt, Artificial Sequence
  derived and/or modified sequence opt3 from VP1__Norovirus_and/or_Norovirus-like__KX354077
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacucgcggcgacggcucuacacgagggcacaaggcuaccguuuacacgggauccgcccccuuuaccccuaaguuggguucagugcaguucgaaacagacacugagaacgauuuugaaacccaucaaaauacaaaauucacuccagucggcgugauccaggacgggggaaccacacacagaaacgagccccagcaauggguccucccgagcuacaguggcaggucugugccuaauguucaccuggcaccagccguggcucccaccuuuccuggugagcaguuacuguucuuucgguccacuaugcccggguguagcggcuauccaaacauggaucucgacugccuucugccucaggaauggguacagcauuucuaccaagaggcggcacccgcccagucggaugucgcuuugcuacguuuugugaauccagacacgggacgcguucuguucgaauguaagcuccacaaaucuggcuaugugacagucgcccauaccgggcagcacgaucuggugauuccgccuaacggauacuuuagauucgacuccuggguaaaccaguucuauacucuugcacccauggguaauggcaccgggaggcggcgauga

SEQ ID NO: 20890 - RNA, 1617 nt, Artificial Sequence
  derived and/or modified sequence opt3 from VP1__Norovirus_and/or_Norovirus-like__KR131785
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuugccccuaagcugggacgagugcaauucgagacagacacuaaucacgauuuugaagcaaaccagaauaccaaauucacaccaguuggugugauccaggacggcgggacuacccacagaaacgagccccaacaguggguauugccgagcuacaguggaaggaauacacauaacguccaccucgccccugcuguggcgccaaccuuucccggcgaacagcuguuauucuuucggucuacuaugccugguuguuccggguaucccaauauggaucuggacugccuccuuccacaggaguggguucaauacuucuaucaggaggcagccccugcucagagcgauguggcccuguugcguuuugucaaccccgacacgggccgcgugcuauucgaauguaagcugcauaaaucgggauacguaacaguggcacacaccggccagcacgaucucguuauuccaccgaacggguauuuuagauucgacucuugggucaaucaauucuacacucuggccccuaugggaaacgguaccggcaggcggcgauga

SEQ ID NO: 20891 - RNA, 1617 nt, Artificial Sequence
  derived and/or modified sequence opt3 from VP1__Norovirus_and/or_Norovirus-like__AB972530
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacuacccacaggaacgagccccaacaguggguauugccgucuuacuccgggcggaauacaccuaacguccaccucgccccagcuguggcgcccaccuuuccuggagaacagcuguuauucuuucguagcacuaugcccggcuguucggguuauccaaauauggaccuggauugccuccuuccucaggaguggguucaauacuucuaucaggaggcagcccccgcucagucugacguggcccuguugcgcuuugucaacccagauacggggagagugcuauucgaauguaagcugcauaaauccggcuacguaacaguggcacacaccggacagcaugaccucguuauuccgccuaauggcuauuuuagguucgauucaugggucaaccaauucuacacucuggcccccauggggaacggaaccggucggcgacgcuga

SEQ ID NO: 20892 - RNA, 1617 nt, Artificial Sequence
  derived and/or modified sequence opt3 from VP1__Norovirus_and/or_Norovirus-like__AB972526
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuugccccuaagcugggacgagugcaauucgagacagacacugaucacgacuuugaagcaaaucagaacaccaaauucacaccaguuggugugauccaggauggcgggacuacccacagaaaugagccccaacaguggguauugccgagcuacaguggaaggaacacacauaauguccaccucgccccugcuguggcgccaaccuuucccggcgaacagcuguuauucuuucggucuacuaugccugguuguuccggguaucccaacauggaccuggauugccuccuuccacaggaguggguucaauacuucuaucaggaggcagccccugcucagagcgacguggcccuguugcguuuugucaaucccgauacgggccgcgugcuauucgaauguaagcugcauaaaucgggauacguaacaguggcacacaccggccagcacgaccucguuauuccaccgaacggguauuuuagauucgauucuugggucaaccaauucuacacucuggccccuaugggaaaugguaccggcaggcggcgauga

SEQ ID NO: 20893 - RNA, 1617 nt, Artificial Sequence
  derived and/or modified sequence opt3 from VP1__Norovirus_and/or_Norovirus-like__AB972522
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcuaacuuugccccuaagcugggaagaauccaauucgagacagauacugaccaugauuuugaagcaaaucagaacaccaaauucacaccaguggguguuauucaggacggcaguacuacccacaggaaugagccccaacaguggguguugccgucuuacuccgggcggaacacaccuaauguacaccucgccccagcugucgcgcccaccuuuccuggagaacagcuguuauucuuucguagcacuaugcccggcuguucggguuauccaaacauggaucuggacugccuccuuccucaggagugggugcaauacuucuaucaggaggcagcccccgcucagucugauguugcccuguugcgcuuugugaauccagacacggggagaguccuauucgaauguaagcugcauaaauccggcuacgugacaguagcacacaccggacagcaugaucucgugaucccgccuaacggcuauuuuagguucgacucauggguuaaccaauucuacacucuggcccccauggggaauggaaccggucggcgacgcuga

SEQ ID NO: 20894 - RNA, 1617 nt, Artificial Sequence
  derived and/or modified sequence opt3 from VP1__Norovirus_and/or_Norovirus-like__AB972514
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucgaaacagacacugagaacgauuuugaaacccaucaaaauacaaaguucacuccagucggcgugauccaggacgggggaaccacacaccgaaacgagccccagcaauggguccucccgagcuacaguggcagaaaugugccuaacguucaccuggcaccagccguggcucccaccuuuccuggugagcaguuacuguucuuuaggucuauuaugcccggguguuccggcuauccaaauauggaucucgacugccuucugccucaggaauggguacagcauuucuaccaagaggcggcacccgcccagagcgaugucgcuuugcuacgguuugugaacccagacacuggacguguucuguucgaauguaaacuccacaagucgggcuaugugacggucgcccauacagggcagcacgaucuggugauaccgccuaacggauacuuucgcuucgacucuuggguaaaucaguucuauacccuugcacccauggguaacggcacugggagaaggcgguga

SEQ ID NO: 20895 - RNA, 1617 nt, Artificial Sequence
  derived and/or modified sequence opt3 from VP1__Norovirus_and/or_Norovirus-like__AB972505
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacugcccacaggaacgagccccaacaguggguauugccgucuuacuccgggcggaauaccccuaacguccaccucgcuccagcgguggcacccacauuuccuggagaacagcuguuauucuuucguagcaccaugcccggcuguucggguuauccaaauauggaccuggauugccuccuuccucaggaguggguucaauacuucuaucaggaggccgcucccgcccagucugacguggcacuguugcgcuuugucaacccagauacugggagagugcuauucgaauguaagcugcauaaauccggcuacguaacgguggcccacacaggacagcaugaccucguuauuccgccuaauggcuauuuuagguucgauucaugggucaaccaauucuacacccuggcucccauggggaacggaacuggucggcgacgcuga

SEQ ID NO: 20896 - RNA, 1617 nt, Artificial Sequence
  derived and/or modified sequence opt3 from VP1__Norovirus_and/or_Norovirus-like__AB972473
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugauagggacuuugaagcaaaucagaacaccaaauucacaccaguuggugugauccaggauggcagcacuacccaucggaaugagccccaacaguggguauugccgaguuacucugggcguaacacacacaauguccaccucgccccugcuguggcgccaaccuuucccggagaacagcuguuauucuuucgcuccacuaugccuggcuguagcgguuaucccaacauggaccuggauugccuccuuccacaggaguggguucaauacuucuaucaggaggcagccccugcucagucggacguggcccuguugagauuugucaaucccgauacggggagggugcuauucgaauguaagcugcauaaaucuggcuacguaacaguggcacacaccggacagcaugaccucguuauuccaccgaacggcuauuuucgguucgauuccugggucaaccaauucuacacucuggccccuauggggaauggaaccggucgacgcagauga

SEQ ID NO: 20897 - RNA, 1617 nt, Artificial Sequence
  derived and/or modified sequence opt3 from VP1__Norovirus_and/or_Norovirus-like__KT780381
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggacauaccugcuccacuggguacucccgacuucgucgggaagauucagggagugcuuacacagaccacucgcacagauggcucaacccgaggccacaaggccacggucuacaccgggagcgcugacuuugccccuaagcugggaagagugcaauucgaaacagauacugaccaugauuuugaggcaaaccagaauaccaaauucacaccaguuggugugauccaggacggcgggacuacccacaggaacgaaccccaacaguggguauugccgaguuacucuggacggaauacaccuaacguccaccucgccccagcuguggcgcccaccuuuccuggcgagcagcuguuauucuuucguuccacuaugcccgguuguagcggguauccaaauauggaucuggacugccuccuuccucaggaauggguucaauacuucuaucaggaggcagcccccgcucagucggauguggcccuguugcgcuuugucaacccagacacgggcagagugcuauucgaguguaagcugcauaaaucuggauacguaacaguggcacacaccggccagcaugaucucguuauuccgccuaauggguauuuuagguucgacuccugggucaaccaauucuacacucuggcccccaugggaaacgguaccggccggcgacgcuga

SEQ ID NO: 20898 - RNA, 1617 nt, Artificial Sequence
  derived and/or modified sequence opt3 from VP1__Norovirus_and/or_Norovirus-like__KT780372
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcagguccuacucgcaggaaacgccuuuacagcuggcaaagugauuuucgccgcaguaccuccaaauuuuccgacugagggccugucucccucgcagguuacgauguucccucauaucguggucgacgugcgccaacuugagccagugcugauucccuugccugauguccgaaacaauuuuuaucacuacaaccagucaaaugacccaaccaucaagcucauagcuaugcuguauacaccccugcgugccaacaacgcgggggaugacguuuucacugugagcugcagaguacucaccaggccgaguccugauuuugacuucaucuuuuuagugcccccaacagucgaaucccggaccaaaccuuucucugugcccguucugacuguggaggaaaugacaaauagccgcuuuccaauuccccuugagaaguuguucaccggaccuuccucagccuucgucgugcagccacagaacgguagauguacgacugauggcguacugcuagggaccacacaacucaguccgguuaauaucugcacuuuuaggggagacgugacccauauuacaggcagccggaacuacaccaugaaucuggcaucucagaacugguccaauuaugaucccacggaggaaaucccugcuccacuugguacucccgacuucgucgggaaaauacagggagugcugacacagaccacucgcacagacggcucaacccgaggccacaaggccacggucuacaccgggagcgcugauuuugccccuaaguugggaagagugcaauucgagacagacacugaucaugacuuugaagcaaaccagaauaccaaauucacaccaguuggugugauucaggauggcaguacuacccacaggaacgagccccaacaguggguacucccgucuuacuccgggcggaauacaccuaacguccaccuggccccagcuguggcgcccaccuuuccuggagaacaguuacuguucuuucguagcacuaugcccggcuguucggguuauccaaauauggaccucgauugccuucugccucaggaguggguucaauacuucuaucaggaggcagcccccgcucagucugacguggccuugcuacgcuuugucaacccagauacggggagagugcuguucgaauguaagcuccauaaauccggcuacguaacaguggcacacaccggacagcaugaccugguuaucccgccuaauggcuauuuuagguucgauucaugggucaaccaauucuacacucuugcccccauggggaacggaaccggucggcgacgcuga

SEQ ID NO: 20899 - RNA, 1617 nt, Artificial Sequence
  derived and/or modified sequence opt3 from VP1__Norovirus_and/or_Norovirus-like__KT202797
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacugauagagacuuugaagcaaaccagaauaccaaauucacaccaguuggugugauccaggauggcgggacuacccacaggaacgagccccaacaguggguauugccgaguuacucuggacgguccacaccuaauguccaccucgccccagcuguggcgcccaccuuuccuggcgaacagcuguuauucuuucguagcacuaugcccgguuguucgggguauccaaacauggaccuggauugccuccuuccucaggaguggguucaauacuucuaucaggaggcagcccccgcucagucugacguggcccuguugcgcuuugucaauccagauacgggcagagugcuauucgaauguaagcugcauaaauccggauacguaacaguggcacacaccggccagcaugaccucguuauuccgccuaacggguauuuuagguucgauucaugggucaaucaauucuacacucuggcccccaugggaaacgguaccggccggcgacgcuga

SEQ ID NO: 20900 - RNA, 1617 nt, Artificial Sequence
  derived and/or modified sequence opt3 from VP1__Norovirus_and/or_Norovirus-like__KR904226
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccgucuuaacuguggaggaaaugacaaauagccgcuuuccaaucccccuggagaaacuuuucaccggaccuuccucagccuucguugugcagccacagaacgguagauguacgacugauggcgucuugcuggggaccacacaacuaaguccggugaauauaugcacuuuuaggggagacguaacccauauuacaggcagccggaacuacaccaugaaucucgcaucucagaacuggaauaacuaugaucccacggaggaaaucccugcuccacuggguacucccgacuucguugggaagauucagggaaugcuuacacagaccacucgcacagacggcuccacccgaggccacaaggccacgguguacaccgggucagcugauuuugccccuaagcugggaagaguccaauucgagacagacacugaucaugacuuugaagcaaaucagaacaccaaauucacaccagugggugucauccaggauggcagcacuacccacaggaaugagccccaacaguggguguugccgaguuacucugggcgguccgcccacaacguucaucucgcuccugcgguggcaccaacauuucccggagaacagcuguuauucuuucguagcaccaugccuggcuguucggguuaucccaauauggaccuggauugccuccuuccacaggaguggguacaauacuucuaucaggaggccgcuccugcccagucugacgucgcacuguugcgcuuugugaaccccgauacugggagaguucuauucgaauguaagcugcacaaauccggcuacgugacggucgcccauacaggacagcacgaccucgugaucccaccgaauggcuauuuuagguucgauucauggguaaaccaauucuacacccuggcuccuauggggaacggaacuggucggcgacgcuga

SEQ ID NO: 20901 - RNA, 1617 nt, Artificial Sequence
  derived and/or modified sequence opt3 from VP1__Norovirus_and/or_Norovirus-like__KR904208
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucguguucucugccguaccuccaaauuuuccgacugagggccucucgcccucacagguuacgauguucccucauauuaucguggacguccgccaacuggagccagugcuuauaccccugccugaugugcgaaacaauuuuuaucacuacaaccagagcaaugacccaaccaucaaguugauugcaaugcucuauacaccccugcgugcuaacaacgccggggaugacgucuucacuguuaguugcagagugcugaccaggccguccccugauuuugacuucaucuuucucguacccccaacaguggaaucucggaccaaaccuuucagcguccccauuuuaacuguggaggaaaugacaaauucccgcuuuccaaucccccuggagaaacuuuucaccggaccuucaaguacguucguugugcagccacagaacgguagauguacuaccgauggcgucuugcuggggacaacucaacuaagcccggugaauauaugcaccuuuaggggagacguaacacauauugcgggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugaugccaaucagaacaccaaauucacaccagucggugugauccaggacggcaauacugcacauaggaacgagccccaacaguggguuuugccguccuacagcgggcggaauacccacaacgugcaccucgccccugcuguagcgccaacauuucccggagaacagcuguuauucuuucguucgaccaugccuggcuguucugguuaucccaauauggaucuggacugccuccuuccacaggaguggguccaauacuucuaucaggaagcagccccugcucaguccgauguggcccuguugcgcuuuguuaaccccgacacugggagagugcuauucgaguguaagcugcauaaaucaggcuacgucacgguggcacacacaggacagcaugaucucguaaucccaccgaacggcuauuuuagguucgacaguugggugaaucacuucuacacccuggccccuguugggaacggaacuggucggcgacgcuga

SEQ ID NO: 20902 - RNA, 1617 nt, Artificial Sequence
  derived and/or modified sequence opt3 from VP1__Norovirus_and/or_Norovirus-like__AB933709
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaaugcugacacagaccacuaagggcgacggcuccacacgcgggcacaaggcuaccguuuacacgggaucagcccccuuuaccccuaaauuggguagcgugcaguucaguacagacacugaaaaugauuuugagacccaucaaaacacaaaguucacuccagucggcgugauccacgacgggucuaccacacaccgaaaugaaccccagcaguggguccucccguccuacagcggaagaaacgugccuaauguucaucuggcaccagccguggcucccaccuuuccuggcgagcaauuacuguucuuuaggucgacuaugcccgguuguucuggguauccaaacauggaucucgacugccuucugccucaggaguggguacagcacuucuaccaggaagcggcacccgcccaauccgaugucgcuuugcuacgguuugugaauccagacacgggccguguucuguucgaguguaaacuccauaagucaggauaugugacagucgcccacaccggccagcacgaucuggugauuccgccuaacggguacuuucgcuucgacaguuggguaaaccaguucuauacucuugcacccaugggaaaugguaccggcagaaggcgguga

SEQ ID NO: 20903 - RNA, 1617 nt, Artificial Sequence
  derived and/or modified sequence opt3 from VP1__Norovirus_and/or_Norovirus-like__EU921352
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagagacuuuucacgggacccucaagugcguucgugguucagccucagaacgguagguguacuaccgauggcguguugcuggggacaacucaacuaagcccagucaauauuugcaccuuucggggagacgugacacauaucgccggcacccaggaguacacgaugaaccucgcaucucagaauuggaacaauuaugauccgacugaagagauucccgcuccucuggguacaccagacuucguagggaagauccagggaguucuuacccaaacuacacgccgagacggcuccaccagaggccacaaagccacggugucaaccgggagcguccauuuuacacccaagcugggaaggauccaguucaguacugauaccucuaacgacuuugaaacaggucagaauacucgguucaccccugugggcgucgugcaagaugggggaacaacccaccagaacgagccacagcaguggguuuugcccgacuacuccggccgugauggucacaaugugcaucucgcuccggccguagcaccuagcuuuccaggggaacaacuguuauucuuucgcucgacuaugcccggcuguucuggauacccuaacaugaaucuggacugccuccuuccccaggaguggguccagcacuucuaucaggaggccgcuccagcgcaauccgauguggcacuguugagauuuguuaacccugacacgggcagggugcuauucgaauguaagcugcauaaaucaggguacgucacaguggcccacaccggacagcacgaucucguaauucccccaaaugguuauuuucgguucgacaguugggugaaccaguucuacacucuggcuccgaugggcaacgggaccggacgacgcagauga

SEQ ID NO: 20904 - RNA, 1617 nt, Artificial Sequence
  derived and/or modified sequence opt3 from VP1__Norovirus_and/or_Norovirus-like__LC005735
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgucuuacuccggacggaacacaccuaauguccaccucgccccagcuguggcgcccaccuuuccuggcgaacagcuguuauucuuucguagcacuaugcccgguuguucgggguauccaaacauggaccuggauugccuccuuccucaggaguggguucaauacuucuaucaggaggcagcccccgcucagucugacguggcccuguugcgcuuugucaauccagauacgggcagagugcuauucgaauguaagcugcauaaauccggauacguaacaguggcacacaccggccagcaugaccucguuauuccgccuaacggguauuuuagguucgauucaugggucaaucaauucuacacucuggcccccaugggaaacgguaccggccggcgacgcuga

SEQ ID NO: 20905 - RNA, 1617 nt, Artificial Sequence
  derived and/or modified sequence opt3 from VP1__Norovirus_and/or_Norovirus-like__KP241909
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaaaccaaccagaauacaaaauucacuccaguuggugugauccaggauggcgggaccacacacaggaacgagccccaacaguggguauugccgaguuacucuggacggaauaccccuaacguccaccucgcaccagccguggcucccacuuuuccuggcgaacagcuguuauucuuucguuccacgaugcccgguuguagcggguauccaaauacagaccuggauugccuccuuccucaggaguggguucaauacuucuaucaggaggcggcacccgcccagucggacguggcucuguugcgcuuugucaacccagauaccggcagagugcuauucgaauguaagcugcauaaaucuggauacguaacuguggcccacaccggccagcaugaccucguuauuccgccuaauggguauuuuagguucgauuccugggucaaccaauucuacacacuggcacccaugggaaacgguaccggccggcgacgcuga

SEQ ID NO: 20906 - RNA, 1617 nt, Artificial Sequence
  derived and/or modified sequence opt3 from VP1__Norovirus_and/or_Norovirus-like__KJ533132
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggaggcagccccugcucagagcgacguggcccuguugcgcuuugucaaucccgauacgggcagagugcuauucgaauguaagcugcacaaaucgggauacguaacaguggcacauaccggccaguaugaccucguuauuccaccgaacggguacuuuagguucgauucuugggucaaccaauucuauacucuggccccuaugggaaaugguaccggccggcgacgcuga

SEQ ID NO: 20907 - RNA, 1617 nt, Artificial Sequence
  derived and/or modified sequence opt3 from VP1__Norovirus_and/or_Norovirus-like__KP176407
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagaauugaaccccuacuuaucccaccuggcccggauguauaauggcuacgcggguggguucgaggugcaggucauucuagcaggaaacgccuuuacagcuggcaaagugaucuucgccgcaguaccuccaaauuuuccgacugagggccucucucccucgcagguuacgauguucccucauauuguggucgaugugcgccaacuggaaccagugcuuaucccccugccugacguccgaaacaauuuuuaucacuacaaccagucaaaugauccaaccauaaaguugaucgcuaugcucuauacaccccugcgugccaacaacgcgggggacgauguuuucacugugagcugcagaguacugaccaggccgaguccugacuuugauuucauuuuucucgugcccccaacagucgagucccggaccaaaccuuucucugugcccguuuuaacuguggaagagaugacaaauagccgcuuuccaaucccccuggagaaacuuuucaccggaccuuccucagccuucgucgugcagccacagaacgguagauguacgacugacggcguauugcuggggaccacacaacuaaguccgguuaauauuugcacuuuuaggggagaugugacccauaucacaggcagccggaacuacaccaugaaucucgcaucucagaacugguccaauuaugaccccacggaagagauaccugcuccacuggguacucccgauuucgucgggaagauucagggagugcuuacacagaccacucgcacagacggcucaacccgaggccacaaggccacggucuacaccgggagcgcugacuuugccccuaagcugggaagagugcaauucgaaacagauacugacagggauuuugaggcaaaccagaauaccaaauucacaccaguuggugugauccaggacggcaguacuacccaucggaacgaaccccaacaguggguauugccgucuuacuccgggcguaauacaccuaacguccaccucgccccagcuguggcgcccaccuuuccuggagagcagcuguuauucuuucgcagcacuaugcccggcuguucggguuauccaaauagagaucuggacugccuccuuccucaggaguggguucaauacuucuaucaggaagcagcccccgcucagucugauguggcccuguugagguuugucaacccagacacggggcgggugcuauucgaguguaagcugcacaaauccggcuacguaacaguggcacauaccggacagcacgaucucguuauuccgccuaauggcuauuuucgauucgacucaugggucaaccaauucuacacucuggcccccauggggaacggaaccggucgcagaagguga

SEQ ID NO: 20908 - RNA, 1617 nt, Artificial Sequence
  derived and/or modified sequence opt3 from VP1__Norovirus_and/or_Norovirus-like__KP176406
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccaucuuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacugguccaauuaugaucccacggaggaaauuccugcuccacuggguauccccgacuucguggggaagauucagggaaugcuuacucagacaacccgcacugacggcucaacacgaggccacaaggccaccgucuacacggggagcgcugauuuugccccuaagcugggaagagugcaauucgagaccgacacagaucaugacuuugaagcaaaccagaauacuaaauucaccccagucggugugauccaggauggcaguacaacucacaggaacgagccccaacaguggguuuugccgucuuacuccgggcggaauaccccuaacgugcaccucgccccagcuguagcgcccacauuuccuggagaacagcuguuauucuuucguagcaccaugcccggcuguucggguuauccaaauauggaccuggauugccuccuuccucaggaguggguccaauacuucuaucaggaggcagcccccgcucagucugacguggcccuguugcgcuuuguuaacccagauacugggagagugcuauucgaauguaagcugcauaaauccggcuacgucacgguggcacacacaggacagcaugaccucguaaucccgccuaauggcuauuuuagguucgauucaugggugaaccaauucuacacccuggcccccauggggaacggaacuggucggcgacgcuga

SEQ ID NO: 20909 - RNA, 1617 nt, Artificial Sequence
  derived and/or modified sequence opt3 from VP1__Norovirus_and/or_Norovirus-like__KP123606
augaagauggccagcuccgacgcuaaccccucugauggcucagcagccaaucuggugccugaggucaacaaugaaguuauggcgcucgagccagugguaggggcuaccaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaagugaucuucgcugccguaccuccaaauuuuccgacggagggccucucucccucgcagguuaccauguucccucauauuguggucgacgugcgccaacuggagccagugcuuaucccccugccugauguccgaaacaauuuuuaucacuacaaccagucaaaugacccaacaauaaaguugaucgcaaugcucuauacuccccugcgugcuaacaacgccggggaugacguuuucaccgugagcugcagaguacugacaaggccgaguccugauuuugacuucauuuuucucgugcccccaaccgucgaaucccggacuaaaccuuucucugugcccaucuuaacaguugaggaaaugaccaauagccgcuuuccaauuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauaaccggcagccggaacuacacgaugaaucucgccucucagaacugguccaauuaugaucccacugaggaaauuccugcaccacuggguauccccgacuucguggggaagauucagggaaugcuuacacagaccacucgcacagacggcucaacccgaggccacaaggcuacggucuacaccgggagcgccgauuuugcuccuaagcugggaagagugcaauucgagacagacacugaucaugacuuugaagccaaccagaauaccaaauucacaccagucggugugauccaggauggcaguacuacccacaggaacgagccccaacaguggguuuugccgucuuacuccgggcggaauacaccuaacgugcaccucgcaccagccguagcucccaccuuuccuggagaacagcuguuauucuuucguagcacuaugcccggcuguucggguuauccaaauauggaccuggauugccuccuuccucaggaguggguccaauacuucuaucaggaggcggcacccgcccagucugacguggcucuguugcgcuuuguuaacccagauacggggagagugcuauucgaauguaagcugcauaaauccggcuacgucacaguggcccacaccggacagcaugaccucguaaucccgccuaauggcuauuuuagguucgauucaugggugaaccaauucuacacucuggcacccauggggaacggaaccggucggcgacgcuga

SEQ ID NO: 20910 - RNA, 1617 nt, Artificial Sequence
  derived and/or modified sequence opt3 from VP1__Norovirus_and/or_Norovirus-like__KP096335
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucacgucucagaacugguccaauuaugaucccacugaggaaauaccugcaccacuggguacacccgacuucgucgggaagauucagggaaugcuuacccagacuacacgcaccgacggcucaacgcgaggccacaaggcuaccguguacacagggagcgccgauuuugcuccuaagcugggaagaguccaauucgagacugacaccgaucaugacuuugaagccaaccagaauacaaaauucacuccaguggguguuauccaggauggcaguaccacacacaggaacgagccccaacaguggguguugccgucuuacuccgggcggaauaccccuaacguacaccucgcaccagccgucgcucccacuuuuccuggagaacagcuguuauucuuucguagcacgaugcccggcuguucggguuauccaaauauggaccuggauugccuccuuccucaggagugggugcaauacuucuaucaggaggcggcacccgcccagucugacguugcucuguugcgcuuugugaacccagauacagggagaguccuauucgaauguaagcugcauaaauccggcuacgugaccguagcccacacuggacagcaugaccucgugauuccgccuaauggcuauuuuagguucgauucauggguuaaccaauucuacacccuggcacccauggggaacggaacaggucggcgacgcuga

SEQ ID NO: 20911 - RNA, 1617 nt, Artificial Sequence
  derived and/or modified sequence opt3 from VP1__Norovirus_and/or_Norovirus-like__KM268095
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaaaccaaccagaauacaaaauucacuccaguuggugugauccaggauggcaguaccacacacaggaacgagccccaacaguggguauugccgucuuacuccgggcggaauaccccuaacguccaccucgcaccagccguggcucccacuuuuccuggagaacagcuguuauucuuucguagcacgaugcccggcuguucggguuauccaaauauggaccuggauugccuccuuccucaggaguggguucaauacuucuaucaggaggcggcacccgcccagucugacguggcucuguugcgcuuugucaacccagauacagggagagugcuauucgaauguaagcugcauaaauccggcuacguaaccguggcccacacuggacagcaugaccucguuauuccgccuaauggcuauuuuagguucgauucaugggucaaccaauucuacacccuggcacccauggggaacggaacaggucggcgacgcuga

SEQ ID NO: 20912 - RNA, 1617 nt, Artificial Sequence
  derived and/or modified sequence opt3 from VP1__Norovirus_and/or_Norovirus-like__KM268094
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccaucuuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacugguccaauuaugaucccacggaggaaauuccugcuccacuggguacucccgacuucguggggaagauccagggaguccuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauucaggauggcaguacuacccacaggaacgagccccaacaguggguguugccgucuuacuccgggcggaauacaccuaacguacaccucgccccagcugucgcgcccaccuuuccuggagaacagcuguuauucuuucguagcacuaugcccggcuguucggguuauccaaauauggaccuggauugccuccuuccucaggagugggugcaauacuucuaucaggaggcagcccccgcucagucugacguugcccuguugcgcuuugugaacccagauacggggagaguccuauucgaauguaagcugcauaaauccggcuacgugacaguagcacacaccggacagcaugaccucgugaucccgccuaauggcuauuuuagguucgauucauggguuaaccaauucuacacucuggcccccauggggaacggaaccggucggcgacgcuga

SEQ ID NO: 20913 - RNA, 1617 nt, Artificial Sequence
  derived and/or modified sequence opt3 from VP1__Norovirus_and/or_Norovirus-like__KM268093
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaguaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgucuuacuccggacggaacacaccuaauguccaccucgccccagcuguggcgcccaccuuuccuggcgaacagcuguuauucuuucguagcacuaugcccgguuguucgggguauccaaacauggaccuggauugccuccuuccucaggaguggguucaauacuucuaucaggaggcagcccccgcucagucugacguggcccuguugcgcuuugucaauccagauacgggcagagugcuauucgaauguaagcugcauaaauccggauacguaacaguggcacacaccggccagcaugaccucguuauuccgccuaacggguauuuuagguucgauucaugggucaaucaauucuacacucuggcccccaugggaaacgguaccggccggcgacgcuga

SEQ ID NO: 20914 - RNA, 1617 nt, Artificial Sequence
  derived and/or modified sequence opt3 from VP1__Norovirus_and/or_Norovirus-like__KM198591
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagagauguucacaacgugcaucuggccccugcaguagcuccaacuuuucccggggagcaguuacuguucuuuaggucuacgaugccuggcuguuccggauaucccaauauggaccucgauugccuucugccacaggaguggguccagcacuucuaccaagaagcggccccugcacagagcgacguggcuuugcuacgguuuguuaaccccgauacaggccgugugcuguucgaguguaaacuccauaagucgggguaugucaccguggcccacacuggacagcacgaccugguaauuccaccgaaugguuacuuucgcuucgauucuugggugaaccaguucuauacccuugcaccuaugggcaacgggacaggaagaaggcgguga

SEQ ID NO: 20915 - RNA, 1617 nt, Artificial Sequence
  derived and/or modified sequence opt3 from VP1__Norovirus_and/or_Norovirus-like__KM198589
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcgcgucauucuagcaggaaacgccuuuacagcuggcaaaaucauuuucgccgcagugccuccaaauuuuccgacugagggccucucucccucgcagguaacgauguucccucauaucauaguugacgugcgacagcuggagccaguccuuaucccccugccugaugugcguaacaauuuuuaucacuacaaccaaaccaaugacucaacaauuaaguugaucgcuaugcucuauacuccacugagagccaacaacgcgggggaagauguguucaccgucagcugcaggguucugacacggcccaguccggacuuugauuucauuuuucucgugccucccaccguagagucccgcacuaaaccauucacagugccuaucuuaaccgucgaagagaugacuaauucuagauuucccauaccacuggagaaacuuuucacgggacccagcggugccuucgugguucagccucagaacgggagguguaccacagacggcguguugcugggaacuacccagcuauccccagucaauauuugcacauuucggggcgaugugacccauaucgcagguucacgcaacuacacgaugaaucucgcuagucugaacuggaauaacuaugacccgacugaagagauucccgccccucuugggacaccagauuucguaggaaagauccaaggcguucugacccagacuacaaagggcgacgggagcacccgaggacacaaggcuacgguguacaccgguucugcccccuuuacaccuaaauugggcuccguccaguucucaacugacaccgaaaaugauuuugagauccaucagaacacaaaguucacuccagugggggucauucaagacggaggcaccacacacagaaaugaaccccagcagugggugcucccgagcuacagugguagggauguucacaacgugcaucuggccccugcaguagcuccaaccuuucccggggagcaauuacuguucuuucggucuacuaugccuggcuguuccggauaucccaauauggaccucgauugccuucugccacaggaguggguccagcacuucuaccaggaagcggccccugcacaaagcgacguggcuuugcuacguuuuguuaaccccgauacgggccgcgugcuguucgaguguaaacuccauagaucgggguaugucacaguggcccacaccggacagcacgaccugguaauaccaccgaaugguuacuuuagguucgauucuugggugaaccaguucuauacucuugcaccuaugggcaacgggaccggacggcgacgcuga

SEQ ID NO: 20916 - RNA, 1617 nt, Artificial Sequence
  derived and/or modified sequence opt3 from VP1__Norovirus_and/or_Norovirus-like__KM198576
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucauugugcagccucagaauggcagauguacuaccgacgggguuuugcugggaacaacucaacuauccccagugaacaucugcaccuuuaggggcgaugucacacauauugcagguucacggaauuacaccaugaaccucgcuagucugaauuggaacaauuaugacccgacggaagagauccccgccccucuugggacuccagauuucgugggaaagauccagggcguacugacacagaccacuaagggcgacgggagcacacgcggacacaaggcuaccguuuacacggguucugcccccuuuaccccuaaauugggcuccgugcaguucucaacagacacugaaaacgauuuugaggcacaucaaaauaccaaguucacaccagucggggugauucaggacggaggcacuacccaccgaaacgaaccccagcaauggguccucccgagcuacagugguagagaugugcacaauguucaucuggccccugcuguggcgccaacauuucccggggagcaguuacuguucuuuaggucuaccaugccuggcuguuccggauaucccaacauggaccucgauugccuucugccacaggaguggguacagcacuucuaccaagaagcagccccugcucagagcgacgucgccuugcuacgguuugugaaucccgauacuggccguguucuguucgaguguaaacuccauaagccaggguaugugacggucgcacacacaggacagcacgaccuggugauaccgccuaacgguuacuuucgcuucgauucguggguaaaccaguucuauacccuugcccccaugggcaaugggacuggaagaaggcgguga

SEQ ID NO: 20917 - RNA, 1617 nt, Artificial Sequence
  derived and/or modified sequence opt3 from VP1__Norovirus_and/or_Norovirus-like__KM198564
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucauugugcagccucagaauggcagauguacuaccgacgggguuuugcugggaacaacucaacuauccccagugaacaucugcaccuuuaggggcgaugucacacauauugcagguucacggaauuacaccaugaaccucgcuagucugaauuggaacaauuaugacccgacggaagagauccccgccccucuugggacuccagauuucgugggaaagauccagggcguacugacacagaccacuaagggcgacgggagcacacgcggacacaaggcuaccguuuacacggguggcgcccccuuuaccccuaaauuggggucugugcaguucuccacagacacugaaaacgauuuugaggcacaucaaaauaccaaguucacaccagucggagugauucaggacggcgguacuacccaccgaaacgaaccccagcaauggguccucccgucauacagcgggagagaugugcacaauguucaucuggccccugcuguggcgccaacauuucccggcgagcaguuacuguucuuuaggaguaccaugccuggauguucuggcuaucccaacauggaccucgauugccuucugccacaggaguggguacagcacuucuaccaagaagcagccccugcucaguccgacgucgccuugcuacgguuugugaaucccgauacugggcguguucuguucgaguguaaacuccauaagagcggauaugugacggucgcacacacaggucagcacgaccuggugauaccaccgaacggcuacuuucgcuucgauucguggguaaaccaguucuauacccuugccccuauggggaauggaacuggcagaaggcgguga

SEQ ID NO: 20918 - RNA, 1617 nt, Artificial Sequence
  derived and/or modified sequence opt3 from VP1__Norovirus_and/or_Norovirus-like__KJ716355
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccaucuuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacuggaauaacuaugaucccacggaggaaauuccugcuccacuggguacucccgacuucguggggaagauccagggaguccuuacacagaccacucgcacagacggcuccacccgaggccacaaggccacgguguacaccgggucagcugauuuugccccuaagcugggaagaguccaauucgagacagacacugaucaugacuuugaagcaaaucagaacaccaaauucacaccaguggguguuauucaggauggcgggacuacccacaggaaugagccccaacaguggguguugccgagcuacaguggacggaacacacacaauguacaucucgccccugcugucgcgccaaccuuucccggcgaacagcuguuauucuuucguucuacuaugccugguuguuccggguaucccaacauggaccuggauugccuccuuccacaggagugggugcaauacuucuaucaggaggcagccccugcucagagcgacguugcccuguugcgcuuugugaaucccgauacgggcagaguccuauucgaauguaagcugcacaaaucgggauacgugacaguagcacauaccggccagcacgaccucgugaucccaccgaacggguauuuuagguucgauucuuggguuaaccaauucuacacucuggccccuaugggaaaugguaccggccggcgacgcuga

SEQ ID NO: 20919 - RNA, 1617 nt, Artificial Sequence
  derived and/or modified sequence opt3 from VP1__Norovirus_and/or_Norovirus-like__KJ685408
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcagacuauucuagcgggaaacgcauuuacggccggcaaaaucauuuucgcugccgucccuccaaauuuuccgaccgagggccucucucccucacaggugacaauguucccucauaucauaguagacguucgccaacuggagccagugcuuaucccccugccugauguccgaaacaauuuuuaucacuacaaccagacuaaugacccaaccauuaaguugaucgcaaugcucuauacaccccugcgugcuaacaacgccggggaugacguguucaccgugucgugcagaguccugacuaggccgagcccugauuuugacuucauuuuucucguucccccaacaguggaaagucggaccaaaccuuucuccguacccguguuaacggucgaggaaaugacuaauucucgcuuuccaaucccccuggagaaacuuuucaccggaccuagcuccgcguucgugguucagccacagaacgguagauguacaacugauggcguguugcuggggaccacacaacuaucaccggucaauauaugcaccuuuaggggagacgugacgcauauuaguggcagccggaacuacacuaugaaucucgccucucagaacuggaacuccuaugaucccacagaggaaaucccugcaccacuggguacccccgacuucguagggaagauucagggaguucuuacucagacaacccgcacggacggcucaacccgaggccacaaggcuacaguguacacugggagcgccgauuuuaguccuaagcugggaagaguccaauucgcuaccgacacagauaaugacuuugagacuaaucagaacaccaaauucacaccagugggugucauccaggauggcgggaccacucaucaaaaugaaccccagcaguggguguugccgucuuacuccggaagggacacgcacaacguucaccucgccccugcaguggccccaacauuucccggcgagcagcuguuauucuuucggagcaccaugccugguuguucgggguaucccaauauggaucuggacugccuccuuccacaagaauggguacaguacuucuaucaggaggcugcgccugcacagucugaugucgcccuguugcguuuugugaaccccgacacuggccgcguucuauucgaguguaagcugcauaaauccggauacgugaccgucgcucacacaggccaacaugaucucgugaucccaccgaauggguauuuuagauucgacucauggguaaaccaguucuacacccuggccccuaugggaaacgguacuggcaggcggcgauga

SEQ ID NO: 20920 - RNA, 1617 nt, Artificial Sequence
  derived and/or modified sequence opt3 from VP1__Norovirus_and/or_Norovirus-like__KJ144999
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguggcgcccccuuuaccccuaaauuggggucuguccaguucuccacagacacugaaaacgauuuugagacccaucaaaauacaaaguucacuccagugggagucauccaggacggcucaaccacacaccgaaacgaaccccagcaaugggugcucccgaauuacagcgguagaaacguucacaaugugcaucuggccccugcaguagcuccaaccuuucccggggagcaguuacuguucuuuaggaguacuaugccuggcuguucuggauaucccaacauggaucucgacugccuucugccacaggaguggguccagcacuucuaccaagaagcggccccugcacaguccgauguggcuuugcuacgguuuguuaaccccgacacgggccgugugcuguucgaguguaaacuccauaagagcggguaugucacaguggcccacaccggacagcacgaucugguaauuccaccgaaugguuacuuucgcuucgacucgugggugaaccaguucuauacucuugcaccuaugggcaauggggccggaagaaggcgguga

SEQ ID NO: 20921 - RNA, 1617 nt, Artificial Sequence
  derived and/or modified sequence opt3 from VP1__Norovirus_and/or_Norovirus-like__KF060016
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaguuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauaaccggcagccggaacuacacgaugaaucucgccucucagaacuggaacuccuaugaucccacugaggaaauuccugcaccacuggguacacccgacuucguggggaagauccagggaguccuuacccagacuacacgcaccaauggcucaacgcgaggccacaaggcuaccguguacacagggagcgccgacuuuaguccuaagcugggaagaguccaauucgcuacugauaccgacaaugauuuugagacaaaccagaauacuaaauucaccccaguggguguuauucaggacggcucuacaacccccaggaacgaaccgcaacaguggguguugccuuccuacagcgggcggaauauccauaacguacaccucgccccagcagucgcccccacuuuuccuggagagcagcuguuauucuuucguucgacgaugcccggcuguucugguuauccaaauauggaucuggacugccuccuuccucaggaaugggugcaauacuucuaucaggaggcugcgcccgcacaguccgauguugcccuguugcgcuuugugaacccagacacagggagaguccuauucgaguguaagcugcacaaaucaggcuacgugaccguagcucauacuggacagcacgaucucgugaucccgccuaacggcuauuuuagguucgacaguuggguuaaucaauucuacacccuggcccccauggggaacggaacaggucggcgacgcuga

SEQ ID NO: 20922 - RNA, 1617 nt, Artificial Sequence
  derived and/or modified sequence opt3 from VP1__Norovirus_and/or_Norovirus-like__KC517367
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugccagcugcagaguccugaccaggcccaguccggacuuugauuucauuuuucucguuccucccacaguggagucccggaccaaaccauucacuguaccuaucuuaacaguggaagagaugaccaacucucgcuuucccauaccacuggagaaacuuuucacgggacccagcuccgcauucgucgugcagccucagaaugguagauguacuaccgacggcguuuugcuggggacaacucaacuaucaccagugaacauuugcaccuuuaggggagaugucacacauaucgcuggcagucggaauuacaccaugaaccucgccagccugaauuggaacaauuaugacccgacggaagagauucccgcuccucuugguacuccagauuucguggggaagauccagggaaugcugacacagaccacuaagggcgacggcucuacacgcgggcacaaggccaccguauacacgggauccgcacccuuuaccccuaaauuggguucaguucaguucgaaacagacacugagaacgauuuugaaacccaucaaaauacaaaguucacuccagugggcgucauccaggacgggggaaccgcccaccgaaacgagccccagcaaugggugcucccgagcuacaguggcagaaaugucccuaacgugcaccuggcuccagcgguugcacccacauuuccuggugagcaguuacuguucuuuaggucuaccaugcccggguguuccggcuauccaaauauggaucucgacugccuucugccucaggaaugggugcagcauuucuaccaagaggccgcucccgcccagagcgauguagcauugcuacgguuugucaacccagacacuggacgugugcuguucgaauguaaacuccacaagucgggcuauguuacgguggcccauacagggcagcacgaucuggucauuccgccuaacggauacuuucgcuucgacucuugggugaaucaguucuauacccuugcucccauggguaacggcacugggagaaggcgguga

SEQ ID NO: 20923 - RNA, 1617 nt, Artificial Sequence
  derived and/or modified sequence opt3 from VP1__Norovirus_and/or_Norovirus-like__KC517366
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaacagcgcuucucucaauuggaacaauuaugacccgacggaagagauucccgccccucuggguacuccagauuucguagggaagauccagggaaugcuuacacagaccacuaagggcgacggcuccacacgcgggcacaaggcuaccguuuacacgggaucagcccccuuuaccccuaaacuggguagcgugcaguucgaaacagacacugagaacgauuuugaaacccaucaaaauacaaaguucacuccagucggcgugauccaggacgggggaaccacacaccgaaacgagccccagcaaugggucuugccgaguuacucuggcagaaaugugccuaacguucaccucgcaccagccguggcucccaccuuuccuggugagcagcuguuauucuuuagguccacuaugcccggguguagcggcuauccaaauauggaucuggacugccuccuuccucaggaauggguacagcauuucuaccaagaggcggcacccgcccagucggaugucgcucuguugcgguuugugaacccagacacgggacguguucuauucgaauguaaacugcacaagucuggcuaugugacagucgcccauaccgggcagcacgaucucgugauuccgccuaacggauacuuucgcuucgacuccuggguaaaucaguucuauacucuggcacccauggguaacggcaccgggagaaggcgguga

SEQ ID NO: 20924 - RNA, 1617 nt, Artificial Sequence
  derived and/or modified sequence opt3 from VP1__Norovirus_and/or_Norovirus-like__KC517359
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccgacuggagccaguccuuaucccccugccugaugugcguaacaauuuuuaucacuacaaccaaucaaaugacagcaccauuaaguugaucgcuaugcucuauacaccacugagagccaacaacgcgggggaagauguguucacugucaguugcaggguucugacccggcccuccccggacuuugauuucauuuuucucgugccucccacaguagagucucgcaccaaaccauucacugugccuaucuuaacagucgaagagaugaccuacagcagauuucccauaccacuggagaaacuuuucacgggacccuccucagccuucgugguucagccucagaaugguagguguacuaccgacggcguguugcuggggacaacucagcuaaguccagucaacauuugcaccuuucggggagaugugacacauaucgcaggcagccgcaauuauaccaugaaccucgcuucucugaauuggaacaauuacgacccgacggaagagauucccgccccucuugguacuccagauuucguagggaagauccaaggaaugcugacacagaccacuaagggcgacggcuccacacgagggcacaaggcuaccguuuacacgggaucagcccccuuuaccccuaaauuggguagcgugcaguucgaaacagacacugagaacgauuuugaaacccaucagaauaucaaguucacaccagucggcgugauucaagacgggggaacuacccacagaaacgagccccagcaguggguccucccgaguuauucuggcaggaaugugccuaacguucaccuggcaccagccguggcucccacauuuccuggugagcaauuacuguucuuucgguccaccaugcccggguguagcggcuacccaaauauggaucucgacugccuucugccucaggaauggguacagcauuucuaucaggaggcggcacccgcccaaucggaugucgcuuugcuacguuuugugaacccagacacuggacgcguucuguucgaauguaaacuccacaagucuggcuacgugacggucgcccauacagggcagcacgaucugauaaucccgccuaauggauauuuuagauucgacuccugggugaaccaguucuacacccuugcacccauggguaacggcacugggaggcggcgauga

SEQ ID NO: 20925 - RNA, 1617 nt, Artificial Sequence
  derived and/or modified sequence opt3 from VP1__Norovirus_and/or_Norovirus-like__KC409303
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugagaccaaucagaacacaaaauucacuccagucggugugauccaggauggcgggaccacacauaggaaugaaccccaacaguggguuuugccguccuacagcggacggaacauccacaaugugcaccucgccccugcaguagccccaaccuuucccggcgagcagcuguuauucuuucguucgacuaugccugguuguucuggguaucccaacauggaccuggauugccuccuuccacaggaauggguccaauacuucuaucaggaggcugcgccugcacaguccgacguggcccuguugcgcuuuguuaaucccgauacgggcagagugcuauucgaguguaagcugcauaaaucaggauacgucacaguggcucacaccggccagcaugaccucguaauuccaccgaacggguauuuuagguucgauaguugggugaaccaauucuacacucuggccccuaugggaaaugguaccggccggcgacgcuga

SEQ ID NO: 20926 - RNA, 1617 nt, Artificial Sequence
  derived and/or modified sequence opt3 from VP1__Norovirus_and/or_Norovirus-like__JX459608
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagacucccgccccucuugggacaccagauuucguaggaaagauucagggcguucugacccagacuacaaagggcgacgggagcacccgcggacacaaggcuacgguguacaccgguucugcccccuuuacaccuaaauugggcuccguccaguucucaacugacaccgaaaacgauuuugagacacaucaaaauacuaaguucaccccagugggggucauccaggacggaggcacaacccaccgaaacgaaccccagcaaugggugcucccgagcuacagugguagaaauguucacaacgugcaucuggccccugcaguagcuccaacuuuucccggggagcaguuacuguucuuuaggucuacgaugccuggcuguuccggauaucccaauauggaucucgacugccuucugccacaggaguggguccagcacuucuaccaagaagcggccccugcacagagcgauguggcuuugcuacgguuuguuaaccccgacacaggccgugugcuguucgaguguaaacuccauaagucgggguaugucaccguggcccacacuggacagcacgaucugguaaucccaccgaacgguuacuuucgcuucgacucuugggugaaucaguucuauacccuugcaccuaugggcaacgggacaggaagaaggcgguga

SEQ ID NO: 20927 - RNA, 1617 nt, Artificial Sequence
  derived and/or modified sequence opt3 from VP1__Norovirus_and/or_Norovirus-like__JQ320073
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaagugaucuucgcugccguaccuccaaacuuuccgacggagggccucucccccucucagguuaccauguucccucauauuguggucgacgugcgccaacuggagccagugcuuaucccccugccugauguccgaaauaacuuuuaucacuacaaucagucgaacgacccaacaauaaaguugaucgcaaugcucuauacuccccugcgugcuaacaaugccggggaagauguuuucaccgugucaugcagaguacugacaaggccgagcccugacuuugauuucauuuuucucgugcccccaaccgucgagagucggacuaaaccuuucacagugcccaucuuaaccguugaagagaugacgaacucccgcuuuccaauuccccuggagaaacuuuucacuggaccuucuggugcguucgugguccagccacagaauggcagauguaccacagacgggguguugcugggaacuacccaacuaagcccgguaaacaucugcacauuuaggggcgauguuacccauauagccgguacgcacaauuacacuaugaaccucgcaucccagaauuggaacaauuaugaccccacagaagagauuccugcuccacuggggacccccgauuucgugggacggauccagggcaugcuuacucagacaacccgcggcgacgggucaacgcgaggacauaaggccaccgucaguacaggugacgugcacuuuacuccuaagcugggcagcauucaauucaacaccgauacaaauaacgacuuugaaacugggcagaauaccaaguucacaccagucggagugguucaggauggcaacgguacccaccaaaaugagccccagcaguggguguugccgucuuacuccgggagaacuggccauaacguacaccucgcuccugccgucgcaccaacguuucccggagaacagcuguuauucuuuaggucaacaaugccuggcuguagcggguaccccaacaugaaucuggacugccuccuuccacaagagugggugcagcauuucuaucaggaggccgcuccugcgcagagugauguugcacuguugcgguuugugaaccccgacaccggacguguccuauucgaauguaaacugcacaagucugguuacgugacuguagcccacaccggccaacaugaucucgugaucccaccgaauggguauuuucgcuucgacuccuggguuaaccaguucuacacacuggcuccuaugggaaauggcaccgguagaaggcgguga

SEQ ID NO: 20928 - RNA, 1617 nt, Artificial Sequence
  derived and/or modified sequence opt3 from VP1__Norovirus_and/or_Norovirus-like__HM802552
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgccaccgacacagauaacgacuuugagacuggccagaauaccagauucacaccagugggggucauccaggauggaaguucuacccauaggaacgaaccccaacaguggguguugccggacuacuccggccggacuguucacaaugugcaccucgcuccugccguagcaccaacguuucccggugagcagcuguuauucuuucguagcacaaugccuggguguucgggcuaccccaacauggaucuggacugccuccuuccacaggaauggguccaacauuucuaucaggaggccgcuccuucucaguccgauguggcgcuguugcgcuuuguuaaucccgacaccggaagagugcuauucgaguguaagcugcacaaagcaggcuacgucacuguggcccauaccgggcagcacgaucucguaauuccaccgaacggauauuuuagguucgacucaugggugaaucaauucuacacacuggcuccuauggguaacggcgccgggcggcgacgcuga

SEQ ID NO: 20929 - RNA, 1617 nt, Artificial Sequence
  derived and/or modified sequence opt3 from VP1__Norovirus_and/or_Norovirus-like__AB541320
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagcgucccggacuaaaccuuucucugugcccagcgucacaguggaagagaugaccaauucccgcuuuccaauccccuuagaaaagcuguucacgggaccuucaagugccuucguugugcagccacagaacgguagauguacuaccgauggcguccuuuuggggacaacucaacugagcccggugaauauaugcaccuuuaggggagacguaacacauauuaccggcucucggaacuacacgaugaaucuagcaacucagaacuggaacuccuaugaucccacagaggagaucccugcuccacucgguacccccgacuucguugggaaaauucagggagugcugacucagacaacccgcgccgacggcucaacgcgaggccacaaggcuaccgucuacacagggagcgccgauuuugcaccuaaacuuggaagagugcaauucgccacugacaccgauaaugacuuugaugcuaaucagaacacaaaguucacuccagucggugugauccaggacggcgauaccgcgcauaggaaugaaccccaacaguggguucugccgaguuacucugggcggaacucccacaaugugcacuuggcaccuacaguagccccaaccuuucccggagagcagcuccuguucuuucguagcacuaugccuggcuguucggguuaucccaacauggacuuagauugccugcucccacaggaauggguccaauacuucuaucaggaggcugccccugcacagucugacguggcccuucugcgcuuuguuaaucccgauacggggagaguguuguucgaauguaagcuacauaaauccggcuacgucacaguggcucacaccggacagcaugaccugguaaucccaccgaacggcuauuuuagguucgacucaugggugaaccaauucuacacucucgccccuauggggaauggaaccggucggcgacgcuga

SEQ ID NO: 20930 - RNA, 1617 nt, Artificial Sequence
  derived and/or modified sequence opt3 from VP1__Norovirus_and/or_Norovirus-like__AB541227
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugagacccaucaaaacacaaaguucacuccagugggggucauccaggacggaggcaccacacaccgaaaugaaccccagcaaugggugcucccgaguuacucugguagagauguucacaacgugcaucuggccccugcaguagcuccaaccuuucccggggagcaguuacuguucuuuagguccacuaugccuggcuguagcggauaucccaauauggaccucgauugccuucugccacaggaguggguccagcacuucuaccaagaagcggccccugcacagucggacguggcuuugcuacgguuuguuaaccccgauacgggccgugugcuguucgaguguaaacuccauaagucuggguaugucacaguggcccacaccggacagcacgaccugguaauuccaccgaaugguuacuuucgcuucgauuccugggugaaccaguucuauacucuugcaccuaugggcaacgggaccggaagaaggcgguga

SEQ ID NO: 20931 - RNA, 1617 nt, Artificial Sequence
  derived and/or modified sequence opt3 from VP1__Norovirus_and/or_Norovirus-like__AB504318
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaaaauccagggccuguugacacagaccacuaagggcgacgggagcacacgcggacacaaggcuaccguuuacacggguucugcccccuuuaccccuaaacucggcggggugcaguucuccacagacacugaaaacgauuuugagacccaucaaaauacaaaguucacuccagucggagugauccaggacggcucaaccacacaccgaaacgaaccccagcaauggguccugccgagcuacagugguagaaaugugcacaacguucauuuagccccugcaguggcuccaaccuuucccggggagcagcuucucuucuuuaggucuacuaugccuggcuguuccggauaucccaauauggaucuugacugccuguugccacaggaguggguacagcacuucuaccaagaagcggccccugcacagagcgaugucgcucuacugcgguuugugaaccccgacacgggccguguucucuucgaguguaaacugcauaagucgggguaugugacagucgcccacaccggacagcacgaucuugugauuccaccgaacgguuacuuucgcuucgacucuuggguaaaucaguucuauacucuggcaccuaugggcaacgggaccggaagaaggcgguga

SEQ ID NO: 20932 - RNA, 1617 nt, Artificial Sequence
  derived and/or modified sequence opt3 from VP1__Norovirus_and/or_Norovirus-like__AB504311
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacuguuucaccaaggaaugcacccggggagauccuuuggagugccccucugggaccagauuugaaccccuacuuaagccaccuggcucggacguauaauggcuacgccgguggguucgaagugcaggucauucuagcgggaaacgcauuuaccgccggcaaaaucauuuucgcugccgugccuccaaauuuuccgacagagggccucucccccucucagguaacuauguucccucauaucauaguugacgugcgccaacuggagccaguccuuaucccccugccugaugugcgaaacaauuuuuaucacuacaaccagucgaaugacucaaccauuaaguugaucgcaaugcucuauacaccacugcgugcuaacaacgccggggaugacguguucaccgucagcugcagaguucugacuaggcccaguccggauuuugacuucauuuuucucgugccucccacaguagaaucccggaccaaaccauucucugugccuaucuuaacggucgaggaaaugacuaauagccgcuuucccauaccacuggagaaacuuuucaccggacccuccucagcguucgugguucagccucagaacgguagauguacaacugauggcguguugcuggggaccacacaacuaaguccagucaauauuugcaccuuuaggggagacgugacgcauaucgccggcacucagaacuacacaaugaaucucgcaagccagaacuggaauaacuaugauccgaccgaggaaauucccgcuccucuggguacuccagacuucguagggaagauccagggaguucuuacacaaaccacgcggcgcgacggcucuacccgaggccacaaggccacaguguccacugggucaguccauuuuacccccaagcugggaagcgugcaguucaguacagauacuucuaaugacuuugagaccggucagaacacaagauucaccccugucggcgugguucaagauggguccacuacgcaccagaaugaaccacagcaguggguguugcccaacuacagcggaagggacucgcacaauguacaucucgcuccggccgucgcaccuacauuuccaggcgagcaacuguuauucuuucggucuaccaugcccgguuguuccggguacccuaacaugaaucuggauugccuccuuccccaggaaugggugcagcacuucuaucaggagucagccccagcucaaagugacguugcgcuguugcguuuugugaacccugauacuggccgcguccuauucgaguguaaacugcauaagagcggauacgugaccguagcacacacaggccagcacgaccucgugauucccccaaacggguauuuuagauucgauuccuggguuaaucaguucuacacccuggccccgaugggaaacggugcuggcaggcggcgauga

SEQ ID NO: 20933 - RNA, 1617 nt, Artificial Sequence
  derived and/or modified sequence opt3 from VP1__Norovirus_and/or_Norovirus-like__FJ537135
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacaucauagaccccuggaucagaaauaacuucguccaggcuccugguggcgaauuuacagugaguccaaggaaugcacccggggagauucuuuggagcgccccucuguccccagauuugaaccccuacuuaucucaccugucgcggauguauaauggauacgcuggcgguuucgaaguucaggugauccuagccgggaacgcguuuacugcaggaaaaauuaucuucgccgcuauaccuccaaauuuuccgacggagggccucucacccagccaggucaccauguucccucauaucauuguggacguacgccaacuggagccaguucuuaucccccugccugaugugcgaaacaauuuuuaucacuacaaccaggcccaugacaguacauugaagcucauugcaaugcuguauacuccacugcgugcuaauaacgccggcgaugacgucuucaccguguccugcagagugcucacaaggcccucuccggauuuugacuucaucuuuuuagucccucccaccguugaaagccggacuaaaccauucacagugccuauacugaccguagaggaaauguccaacucacgcuuucccauuccacuugagaaguuguacacggggcccaguagcgcguucgugguccagccucagaauggaagauguacuaccgauggugugcugcuaggcacaacucaacucucugccguuaacaucugcaauuucaggggagacgugacccgggucgggauuucccacgauuauacaaugaaccuggugucacagaauuggaacaauuacgacccaaccgaggaaaucccggcaccccuuggcacgccugacuuuguagguaaaauccaggggcuguugacucagacaacccgcgcugauggaagcacucgagcccauaaggcuacaguuaguaccggcucugugcacuucacgccaaagcucggcuccguccaauuuaccacagacacuaacaaugauuuccagaccgggcagaacacaaaauuuacucccgugggagucauucaagacggugaucaccaucagaaugagccucagcagugggugcugccaaacuacagcggcaccucggggcacaauguucauuuagcccccgcaguggccccgacauucccuggagaacaacugcucuuuuucagaucuaccaugccaggcuguuccgguuaucccaacaugaaucuugacugccuguugccucaggaguggguaucacacuuuuaccaggaagcugcgcccgcacagagugaugucgcccuacugagguucgugaacccagacacugggcggguucucuuugaguguaagcugcacaaaagcggcuauauaacgguggcucauacaggaccuuacgaucuugucauucccccaaacggcuauuuccguuuugacuccugggugaaucaauucuacacccuggccccgauggggaacggaucuggucgcaagagaguauga

SEQ ID NO: 20934 - RNA, 1617 nt, Artificial Sequence
  derived and/or modified sequence opt3 from VP1__Norovirus_and/or_Norovirus-like__GQ413969
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggagcaacuacgauccgacugaggaaauucccgccccucuggguacaccagacuuuguagggaagauccagggaaugcuuacccagacuacaggccgagacggcucuaccagagggcacaaagcuacgguucugaccggauccgccgauuucgcacccaaguuggguagggugcaauuugccacagacacugauaaugacuucgagucaggcgaaaacaccaaguuuacaccugucggggugauccaggauggaagcacuacccaucggaaugagccacagcaauggguccuccccaacuacaguggccguacaggucacaaugugcaccuggcuccggcgguugcaccuaccuauccaggggaacaguuacuguucuuucgcucuacuaugcccggcuguuccggauacccuaacauggaccucgauugccuucugccccaggagugggugagacauuucuaucaggaggccgcuccagcccaaagcgacguagcauugcuaagguuugucaauccugauacgggccgggugcuguucgaauguaaacuccacaagcccggguacguuacaguggcccauaccggacagcacgaccuggucauuccaccgaacgguuauuuucgauucgauucgugggugaaccaguuuuacacucuugcuccuaugggcaaugggaccggacgcagaagguga

SEQ ID NO: 20935 - RNA, 1617 nt, Artificial Sequence
  derived and/or modified sequence opt3 from VP1__Norovirus_and/or_Norovirus-like__EU839592
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccgccuacacgggauccgcacccuuuaccccuaaauuggguucagugcaguucagcacagacacugaaaacgauuuugagacccaucaaaauacaaaguucgccccagucggcgugauccaggacgggggaacuacccaccgaaacgaaccccagcaauggguccucccgaguuacucuggcagaaaugugccuaacguucaccuggcuccagcgguggcacccacauuuccuggugagcaguuacuguucuuuagguccaccaugcccggguguagcggcuauccaaauauggaucucgacugccuucugccucaggaguggguacagcauuucuaccaagaagccgcucccgcccagucggaugucgcauugcuacgguuugugaacccagacacuggacguguucuguucgaguguaaacuccacaagucuggcuaugugacggucgcccauacagggcagcacgaucuggugauuccgccuaacggauacuuucgcuucgacuccuggguaaaucaguucuauacccuugcucccauggguaacggcacugggagaaggcgguga

SEQ ID NO: 20936 - RNA, 1617 nt, Artificial Sequence
  derived and/or modified sequence opt3 from VP1__Norovirus_and/or_Norovirus-like__EU839587
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcgggccuaccgcaugaaccucgcaagccagaauuggaacaauuaugaucccacugaggaaauuccugcuccacuggguacacccgacuucguagggaagauccagggaaugcuuacccagacuacaaagggcgacggcucuacccgagggcacaaggccacgguuuccaccggaucaguggauuuuacaccuaaacuggguagcguccaauucgcuacugacaccgauaacgacuuugagacaggccagaauacuagauucaccccagugggggucauccaggauggaaguucuacacauaggaacgaaccccaacaguggguguugccggacuacuccggccggaccguucacaaugugcaccucgccccugcaguagccccaacuuuucccggugagcagcuguuauucuuucguagcacgaugccuggguguucgggcuaccccaacauggaucuggacugccuccuuccacaggaauggguccaacauuucuaucaggaggcugcgccuucucaguccgauguggcacuguugcgcuuuguuaaucccgacacaggaagagugcuauucgaguguaagcugcacaaagccggcuacgucaccguggcucauacugggcagcacgaucucguaauuccaccgaacggauauuuuagguucgacucaugggugaaucaauucuacacccuggccccuauggguaacggcgcagggcggcgacgcuga

SEQ ID NO: 20937 - RNA, 1617 nt, Artificial Sequence
  derived and/or modified sequence opt3 from VP1__Norovirus_and/or_Norovirus-like__EU839583
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgccaccgacacagauaacgacuuugagacuggccagaauaccagauucacaccagugggggucauccaggauggaaguucugcucauaggaacgaaccccaacaguggguguugccggacuacuccggccggaccguucacaaugugcaccucgccccugcaguagccccaacuuuucccggugagcagcuguuauucuuucguagcacgaugccuggguguucgggcuaccccaacauggaucuggacugccuccuuccacaggaauggguccaacauuucuaucaggaggcugcgccuucucaguccgauguggcacuguugcgcuuuguuaaucccgacacaggaagagugcuauucgaguguaagcugcacaaagccggcuacgucaccguggcucauacugggcagcacgaucucguaauuccaccgaacggauauuuuagguucgacucaugggugaaucaauucuacacccuggccccuauggguaacggcgcagggcggcgacgcuga

SEQ ID NO: 20938 - RNA, 1617 nt, Artificial Sequence
  derived and/or modified sequence opt3 from VP1__Norovirus_and/or_Norovirus-like__AB303931
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguacccacaauuacacgaugaaccucgcuucacagaauuggaacaauuaugacccgacugaagagauucccgccccucuggggacaccagauuucguaggacggauccagggcaugcuuacccagacuacacgcggcgacgggaguacccgaggacauaaggcuacgguuagcaccggugacgugcacuuuacacccaagcugggcucuauccaauucaacacugauaccaauaacgacuuugaaacagggcagaauacuaaguucaccccugucggagugguccaggauggcaacggugcccaccaaaaugagccacagcaguggguguugcccuccuacucagggagaacaggccauaacguucaccucgcaccggccguggcuccuaccuuuccaggagaacagcuguuauucuuuaggagcacuaugcccggcuguaguggguacccuaacaugaaucuggacugccuccuuccccaagaguggguacagcauuucuaucaggaggcggcaccagcccagucugaugucgcucuguugcgguuugugaacccugacacgggacguguucuauucgaauguaaacugcacaaguccgguuacgugacagucgcccacaccggccaacaugaucucgugauucccccaaauggguauuuucgcuucgacagcuggguaaaccaguucuacacucuggcaccgaugggaaauggcaccgguagaaggcgguga

SEQ ID NO: 20939 - RNA, 1617 nt, Artificial Sequence
  derived and/or modified sequence opt3 from VP1__Norovirus_and/or_Norovirus-like__KY341923
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucuuuucccguguuaacuguugaggaaaugacaaauagccgcuucccaaucccccuggagaaacuuuucaccggaccuuccucagccuuugugguccagccacagaacgguagauguacgacugauggcguguugcuggggaccacacaacuaaguccgguaaauauuugcacuuucaggggagacguuacccauaucacaggcagccggaacuacaccaugaaucucgcaucucagaacuggaauaacuaugaucccacggaggaaauaccugcuccacuggguacucccgacuuuguggggaagauucagggaguccuuacacagaccacucgcacagacggcuccacccgaggccacaaggccacgguguacaccgggucagcugauuucgccccuaagcugggaagaguccaauuugagacagacacugaucaugacuucgaagcaaaucagaacaccaaauuuacaccaguggguguuauccaggauggcagcacuacccacaggaaugagccccaacaguggguguugccgaguuacucugggcggaacacaccuaauguacaccucgccccagcugucgcgcccaccuucccuggagaacagcuguuauuuuuccguuccacuaugcccggcuguagcgguuauccaaacauggaccuggauugccuccuuccucaggagugggugcaauacuuuuaucaggaggcagcccccgcucagucggacguugcccuguugcgcuucgugaauccagauacggggagaguccuauuugaauguaagcugcauaaaucuggcuacgugacaguagcacacaccggacagcaugaccucgugauuccgccuaacggcuauuucagguucgauuccuggguuaaccaauuuuacacucuggcccccauggggaauggaaccggucggcgacgcuga

SEQ ID NO: 20940 - RNA, 1617 nt, Artificial Sequence
  derived and/or modified sequence opt3 from VP1__Norovirus_and/or_Norovirus-like__KX514317
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaacgccggggaugacguguucacagucaguugcagaguucugaccaggcccuccccggauuuugacuucauuuuucucgugccucccacuguagaaucucggagcaaaccauucuccgugccugucuuaacaguggaggaaaugaccaacucacgcuuucccgcgacgcuggauaaacuuuucacuggaccaaguagcaccuucguugugcagccccagaaugguagauguacaaucgacggcgaguugcuggggacuacccaacuaucuuccgucaacauaugcacauuuaggggagaugugacccauccucgggacucaaagauuuacacgaugaaucucgccagcccaaacuggaauaacuaugacccgacugaggaaauccccgcaccucugggcacaccagauuucguagguaagauucaggggaugcuuacccagacuacaaagggagagggcaguacccgcggccaccgagcuacgguuuacguggggucugccaauuacgcucccaaacugggaagaguccaguuugaaaccgacacaacugaugacuuggaugcccaucaaaacaccaaguucacaccugugggugucgugcagggcggggaguccccaaaaggaagcgaaccccagcaauggguucucccgaauuauucgggcgcaaacacuuuuaaugugcaccuggccccugcuguagcgccaaacuuccccggugagcaguuacuguuuuucaggucuacccucccuggguguggcggacaccccaauauggaccuugauugccuguugccacaggaguggguccagcauuuuuaccaagaagcagccccugcucaguccgacguggcccuacugcgguucguuaaccccgauacaucacgugugcucuuugaguguaagcugcacaaaaguggcuaugucaccguggcacauacugggcaguacgaccuuguacugccaagcaauggauauuuccgcuuugauuccugggugaaccaguucuacacguuggccccgauggguaacggcacagggagaaggcgguga

SEQ ID NO: 20941 - RNA, 1617 nt, Artificial Sequence
  derived and/or modified sequence opt3 from VP1__Norovirus_and/or_Norovirus-like__KU678204
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaguaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggaaugcuuacacagaccacucgcacagacggcagcacccgaggccacaaggccacgguguacaccgggagugcugauuuugccccuaagcugggaagaguccaauucgagacagacacugaucaugacuuugaagcaaaucagaacaccaaauucacaccaguggguguuauccaggauggcucuacuacccacaggaaugagccccaacaguggguguugccguccuacagcgggcggaacacaccuaauguacaccucgccccagcugucgcgcccaccuuuccuggagaacagcuguuauucuuucguucgacuaugcccggcuguucugguuauccaaacauggaccuggauugccuccuuccucaggagugggugcaauacuucuaucaggaggcagcccccgcucaguccgacguugcccuguugcgcuuugugaauccagauacggggagaguccuauucgaauguaagcugcauaaaucaggcuacgugacaguagcacacaccggacagcaugaccucgugauuccgccuaacggcuauuuuagguucgauaguuggguuaaucaauucuacacucuggcccccauggggaacggaaccggucggcgacgcuga

SEQ ID NO: 20942 - RNA, 1617 nt, Artificial Sequence
  derived and/or modified sequence opt3 from VP1__Norovirus_and/or_Norovirus-like__KX158283
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgccugccaaucccccuugagagauuguuuaccggaccuuccucagccuucgucgugcagccacagaacgguagguguacgacugauggcguacugcuagggaccacacaacucaguccgguuaauauuugcacuuuccggggagacgugacccauaucacaggcagccacaacuacaccaugaaucuggcaucucagaacuggaauaacuaugaucccacggaggaaauaccugcuccacuugguacucccgacuuugucgggaagauucagggagugcugacacagaccacucgcacagacggcuccacccgaggccauaaagccacggucuacaccgggucagcugaguucgccccuaaguugggaagagugcaauuugaaacagauacuaaucacgacuucgaggcaaaccagaauaccaaguuuacaccaguuggugugauccaggauggcagcacuacccacaggaacgaaccccaacaguggguacucccgaguuacucugggcggaauacacauaacguccaccuggccccugcuguggcgccaaccuuccccggagagcaguuacuguuuuuccguuccacuaugccuggcuguagcgguuaucccaauauggaccucgauugccuucugccacaggaguggguucaauacuuuuaucaggaagcagccccugcucagucggacguggccuugcuacgcuucgucaaccccgauacggggagagugcuguuugaguguaaacuccauaagucuggcuacauuacaguagcacacaccggacagcacgaccuggugaucccaccgaacggcuauuucagguuugauuccuggguuaaucaauucuacacucuugccccuauggggaacggaaccggucggcgacgcuga

SEQ ID NO: 20943 - RNA, 1617 nt, Artificial Sequence
  derived and/or modified sequence opt3 from VP1__Norovirus_and/or_Norovirus-like__KX354088
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaauuauucacugugccaauccugacagucgaggaaaugaccaacucucgcuuuccuauaccccuugagaaguuguucacgggaccaagcuccgccuucgugguucagccccagaaugguagauguacuaccgauggcgugcugcuagggacaacucaacucucaccugucaacauuugcaccuuuaggggagacgugacacauaucgcaggcagucggaauuacaccaugaaccuggcuagccuuaauuggaacaauuaugauccaacggaggaaauuccggcuccccuggguacuccugacuucguagggaaaauccagggaguuuugacacagaccacuaagggcgacggcucuacacgcgggcacaaggccaccguguacacgggauccgccgauuuuaccccaaaacucgguucaguccaguucgcaacagacacugagaacgauuuugaaacccaucaaaauacacgauucacucccgugggcgucauccaggacgggggaaccacacacagaaacgagccucagcaaugggugcugccaagcuacaguggcaggaauguucacaacgugcauuuagcccccgcuguagcgccgaauuuuccuggugaacagcuccucuucuuucggucuaccaugccaggguguuccggcuaucccaacauggaucuugacugccuguugccucaggaguggguccagcacuucuaccaagaggcagcccccgcucagagcgauguggcccuacugcguuuuguuaacccagacacuggacgcgugcuguucgaauguaagcugcauaaaucgggcuaugucacgguggcacacacagggcaguacgaucuuguaauuccucccaauggauauuuuagauucgacucuugggugaaccaguucuacacccuggccccaauggguaauggcacugggaggcggcgauga

SEQ ID NO: 20944 - RNA, 1617 nt, Artificial Sequence
  derived and/or modified sequence opt3 from VP1__Norovirus_and/or_Norovirus-like__KX354032
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacguuggggaugacguguucacuguaaguugcagagugcugaccaggccguccccugauuuugacuucauuuuucucgucccuccaacaguggaaucucggaccaaaccuuucagcguucccguguuaacugucgaggaaaugacaaacucccgcuuuccaaucccccuggagaaacuuuucaccggaccuucaagugcguucgugguacagccacagaaugguagauguacgacugauggcguuuugcuggggaccacacaacuaagcccggugaacauuugcacuuuuaggggagacgucacccauaucacaggcucucggaauuacaccaugaaccucgccucccagaauuggaacaauuaugaucccacggaggaaauaccugcaccacuggguacucccgacuucguggggaagauucagggaguccuuacacagaccacucgcacagacggcucaacccgaggccacaaggcuacgguguacaccgggagcgccgauuuugcuccuaagcugggaagaguucaauucgagacagacacugaucaugacuuugaagccaaccagaauaccaaauucacaccaguggguguaauccaggauggcaguacuacccacaggaacgagccccaacagugggucuugccgucuuacuccgggcggaauacacacaacgugcaucucgcacccgccguugcuccaaccuuucccggagaacagcuguuauucuuucguagcacuaugccuggcuguucggguuaucccaauauggaccuggauugccuccuuccacaggagugggugcaauacuucuaucaggaggcggccccugcacagucugacgucgcucuguugcgcuuugugaaccccgauacggggagaguacuauucgaauguaagcugcacaaauccggcuacgugacaguugcccauaccggacagcacgaccucgucauuccaccgaauggcuauuuuagguucgauucaugggugaaccaauucuacacucuggcaccuauggggaacggagccggucggcgacgcuga

SEQ ID NO: 20945 - RNA, 1617 nt, Artificial Sequence
  derived and/or modified sequence opt3 from VP1__Norovirus_and/or_Norovirus-like__KX354015
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggaacaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacuacccacaggaacgagccccaacaguggguauugccgucuuacuccgggcggaauacacacaacguccaucucgccccugcuguggcgccaaccuuucccggagaacagcuguuauucuuucguagcacuaugccuggcuguucggguuaucccaauauggaccuggauugccuccuuccacaggacuggguucaauacuucuaucaggaggcagccccugcucagucugauguggcccuguugcgcuuugucaaccccgacacggggagagugcuauucgaguguaagcugcacaaauccggcuacguaacaguggcacauaccggacagcacgaucucguuauuccaccgaauggcuauuuuagguucgacucaugggucaaccaauucuacacucuggccccuauggggaacggagcuggucggcgacgcuga

SEQ ID NO: 20946 - RNA, 1617 nt, Artificial Sequence
  derived and/or modified sequence opt3 from VP1__Norovirus_and/or_Norovirus-like__KX353999
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucagcggcucucggaacuacaccaugaaucucgccucccagaacuggaacucauaugaucccacggaggaaauuccugcaccacuggguacucccgacuucguagggaagauccagggaguucuuacacagaccacuagcacagacggcaguacccgcggccacaaggcuacgguguacaccgggucugccgauuuuuccccuaagcugggacgaguccaauucgcuacagacacugauaaugacuuugagaccaaucagaacacaaaauucacuccagugggugucauccaggauggcgggaccacacauagaaaugaaccccaacaguggguguugccgagcuacucgggaaggaacauucacaauguucaccucgccccugcaguggccccaaccuuucccggcgagcagcuguuauucuuucggucuacuaugccugguuguuccggguaucccaacauggaccuggauugccuccuuccacaggaauggguacaauacuucuaucaggaggcugcgccugcacagucagacgucgcccuguugcguuuugugaaucccgauacgggccgcguucuauucgaguguaagcugcauaaaaguggauacgugacagucgcucacaccggccagcaugaccucgugauaccaccgaacggguauuuuagauucgauagcuggguaaaccaauucuacacucuggccccuaugggaaaugguaccggcaggcggcgauga

SEQ ID NO: 20947 - RNA, 1617 nt, Artificial Sequence
  derived and/or modified sequence opt3 from VP1__Norovirus_and/or_Norovirus-like__KX353987
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacaguacaauuaaguugaucgcaaugcucuauacuccacugcgugcuaauaacgccggggaugacguguucaccgucuccugcagaguucugacaaggcccucuccggauuuugacuucauuuuucucgugccucccaccguagaaagccggacuaaaccauucuccgugccugucuuaacaguggaggaaaugaccaacucacgcuuucccaucccacuggagaaacuuuucacgggacccaguagcgcguucguugugcagccucagaaugguagauguacuaccgauggcgucuugcuggggacaacucaacuaucuccagugaacauaugcaccuuuaggggagacguaacacauauuuccggcucacacaauuacaccaugaaccucgccagccagaauuggaacaguuaugauccgacggaggaaauccccgcaccucuggguacuccagacuucguugggaagauucagggagugcuuacacagaccacuaagacaaauggcucuacccggggccauaaggcuacggucuacaccggguccgccgacuuuagccccaaacugggacgcgugcaauucgcuacagauacugacaacgauuuugagaccaaucagaacacaaaguucacuccugucggugugauccaggacggcucgaccacaccacgaaaugaaccccaacaguggguuuugccgucuuacuccgggagaaacacccacaaugugcaccucgccccugcaguagccccaacuuuucccggagagcagcuguuauucuuuaggucaacgaugccuggcuguagugguuaucccaacauggaucuggacugccuccuuccacaggaauggguccaauacuucuaucaggaggcugcgccugcacagagcgauguggcccuguugcgguuuguuaaucccgacacagggcgugugcuauucgaguguaaacugcauaaguccggcuacgucaccguggcucacacuggacagcaugaucucguaaucccaccgaacggcuauuuucgcuucgacucuugggugaaccaauucuacacccuggccccuauggggaauggaacagguagaaggcgguga

SEQ ID NO: 20948 - RNA, 1617 nt, Artificial Sequence
  derived and/or modified sequence opt3 from VP1__Norovirus_and/or_Norovirus-like__KX353970
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauacccauaacgugcaccucgccccagcaguagcccccacuuuuccuggagagcagcuguuauucuuucguucuacgaugcccggcuguuccgguuauccaaauauggaucuggacugccuccuuccucaggaauggguccaauacuucuaucaggaggcugcgcccgcacagucagauguggcccuguugcgcuuuguuaacccagacacagggagagugcuauucgaguguaagcugcacaaaaguggcuacgucaccguggcucauacuggacaguaugaucucguaaucccgccuaacggcuacuuuagguucgacagcugggugaaucaauucuauacccuggcccccauggggaacggaacaggucggcgacgcuga

SEQ ID NO: 20949 - RNA, 1617 nt, Artificial Sequence
  derived and/or modified sequence opt3 from VP1__Norovirus_and/or_Norovirus-like__KU985156
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggaggcagccccugcucagagcgacguggcccuguugcgcuuugucaaucccgauacgggcagagugcuauucgaauguaagcugcacaaaucgggauacguaacaguggcacauaccggccagcacgaccucguuauuccaccgaacggguauuuuagguucgauucuugggucaaccaauucuacacucuggccccuaugggaaaugguaccggccggcgacgcuga

SEQ ID NO: 20950 - RNA, 1617 nt, Artificial Sequence
  derived and/or modified sequence opt3 from VP1__Norovirus_and/or_Norovirus-like__KU985155
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaaguuaaucagaacaccaaauucacaccaguggguguaauccaggauggcgggacuacccacaggaaugagccccaacagugggucuugccgagcuacaguggacggaacacacacaaugugcaucucgccccugcaguugcuccaaccuuucccggcgaacagcuguuauucuuucguucuacuaugccugguuguuccggguaucccaacauggaccuggauugccuccuuccacaggagugggugcaauacuucuaucaggaggcggccccugcacagagcgacgucgcucuguugcgcuuugugaaucccgauacgggcagaguacuauucgaauguaagcugcacaaaccaggauacgugacaguugcccauaccggccagcacgaccucgucauuccgccuaacggguauuuuagguucgauucgugggugaaccaauucuacacucuggcacccaugggaaaugguaccggccggcgacgcuga

SEQ ID NO: 20951 - RNA, 1617 nt, Artificial Sequence
  derived and/or modified sequence opt3 from VP1__Norovirus_and/or_Norovirus-like__KM514075
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacugauagagacuuugaagcaaaccagaauaccaaauucacaccaguuggugugauccaggauggcgggacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggaccuggauugccuccuuccucaggaguggguucaauacuucuaucaggaggcagcccccgcucagucggacguggcccuguugcgcuuugucaacccagauacgggcagagugcuauucgaauguaagcugcauaaaucuggauacguaacaguggcacacaccggccagcaugaccucguuauuccgccuaauggguauuuuagguucgauuccugggucaaccaauucuacacucuggcccccaugggaaacgguaccggccggcgacgcuga

SEQ ID NO: 20952 - RNA, 1617 nt, Artificial Sequence
  derived and/or modified sequence opt3 from VP1__Norovirus_and/or_Norovirus-like__AB972484
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacgggacacacacaacguccaucucgccccugcuguggcgccaaccuuucccggcgaacagcuguuauucuuucguucuacuaugccugguuguuccggguaucccaauauggaucuggacugccuccuuccacaggaguggguucaauacuucuaucaggaggcagccccugcucagagcgauguggcccuguugcgcuuugucaaccccgacacgggcagagugcuauucgaauguaagcugcacaaaucgggauacguaacaguggcacauaccggccagcacgaucucguuauuccaccgaauggguauuuuagguucgacucuugggucaaccaauucuacacucuggccccuaugggaaacgguaccggccggcgacgcuga

SEQ ID NO: 20953 - RNA, 1617 nt, Artificial Sequence
  derived and/or modified sequence opt3 from VP1__Norovirus_and/or_Norovirus-like__KT780391
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuuagcccuaagcugggaagagugcaauucgagacagacacugaucaugacuuugaagccaaucagaacaccaaauucacaccaguuggugugauccaggauggcgggacuacccacaggaaugagccccaacaguggguauugccgaguuacucuggacggaacacaccuaauguccaccucgcaccagccguggcucccaccuuuccuggcgaacagcuguuauucuuucguuccacuaugcccgguuguagcggguauccaaacauggaccuggauugccuccuuccucaggaguggguucaauacuucuaucaggaggcggcacccgcccagucggacguggcucuguugcgcuuugucaauccagauacgggcagagugcuauucgaauguaagcugcauaaaucuggauacguaacaguggcccacaccggccagcaugaccucguuauuccgccuaacggguauuuuagguucgauuccugggucaaccaauucuacacucuggcacccaugggaaaugguaccggccggcgacgcuga

SEQ ID NO: 20954 - RNA, 1617 nt, Artificial Sequence
  derived and/or modified sequence opt3 from VP1__Norovirus_and/or_Norovirus-like__KT780390
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauacaaccggcagccacaacuacacgaugaaucucgcaucucagaacugguccaauuaugaucccacugaggaaaucccugcuccacuggguacacccgacuucgucgggaagauacagggagugcuuacccagacuacacggaccgacggcucaacgcgcggccauaaggccaccgucuacacagggagcgcugauuuugccccuaagcugggacgagugcaauucgagacugacaccgaucacgacuuggaagcaaaccagaauacaaaauuuacuccaguuggugugauucaggauggcggggccacccacagaaacgagccccaacaguggguacucccgaguuacucuggaaggaauacaccuaacguccaucuggcuccagcgguggcacccaccuucccuggcgaacaguuacuguuuuuccgguccacuaugcccgguuguagcggguauccaaauauggaccucgauugccuucugccucaggaguggguucaauacuuuuaucaggaggccgcucccgcccagucggacguggcauugcuacguuucgucaacccagauacgggccgcgugcuguuugaauguaagcuccacaaaucuggauacguaacaguggcccauaccggccagcacgaccugguuaucccgccuaauggguauuucagauuugauuccugggucaaccaauucuacacucuugcucccaugggaaacgguaccggcaggcggcgauga

SEQ ID NO: 20955 - RNA, 1617 nt, Artificial Sequence
  derived and/or modified sequence opt3 from VP1__Norovirus_and/or_Norovirus-like__KT780376
augaagauggccagcuccgacgcuaaccccucugauggcucagcagccaaucuggugccugaggucaacaaugaaguucucgcgcuugagccagugguaggggcugccaucgcagccccgguggcuggacagcaaaacgucauugaccccuggauaagaaauaacuucgugcaggcaccugguggcgaauuuaccguuaguccaaggaaugcccccggggagauccuguggagcgcuccuuugggaccagauuuaaaccccuaccugucccaccuagcccggauguauaauggcuacgcggguggguucgaagugcaggucauucucgcaggaaacgccuuuacagcuggcaaagugaucuucgccgcaguaccuccaaauuuuccgacugagggccugucucccucgcagguuacgauguucccucauauuguggucgacgugcgccaacuugagccagugcugauccccuugccugauguccgaaacaauuuuuaucacuacaaccagucaaaugacccaaccauaaagcucaucgcuaugcuguauacaccccugcgugccaacaacgcgggggaugacguuuucacugugagcugcagaguacucaccaggccgaguccugauuuugacuucaucuuuuuagugcccccaacagucgaaucccggaccaaaccuuucucugugcccguucugacuguggaggaaaugacaaauagccgcuuuccaauuccccuugagaaguuguucaccggaccuuccucagccuucgucgugcagccacagaacgguagauguacgacugauggcguacugcuagggaccacacaacucaguccgguuaauauuugcacuuuuaggggagacgugacccauaucacaggcagccacaacuacaccaugaaucuggcaucucagaacugguccaauuaugaucccacggaggaaauaccugcuccacuugguacucccgacuucgucgggaaaauucagggagugcugacacagaccacucggacagacggcucaacccgcggccauaaggccacggucuacaccgggagcgcugauuuugccccuaaguugggacgagugcaauucgagacagacacuaaccacgauuuugaagcaaaucagaacaccaaauucacaccaguuggugugauccaggacggcaguacuacccacagaaaugagccccaacaguggguacucccgucuuacuccgggaggaacacaccuaauguccaucuggccccagcuguggcgcccaccuuuccuggagaacaguuacuguucuuucggagcacuaugcccggcuguucggguuauccaaacauggaucucgacugccuucugccucaggaguggguucaauacuucuaucaggaggcagcccccgcucagucugauguggccuugcuacguuuugucaauccagacacggggcgcgugcuguucgaauguaagcuccacaaauccggcuacguaacaguggcacauaccggacagcacgaucugguuauuccgccuaacggcuauuuuagauucgacucaugggucaaccaauucuacacucuugcccccauggggaauggaaccgguaggcggcgauga

SEQ ID NO: 20956 - RNA, 1617 nt, Artificial Sequence
  derived and/or modified sequence opt3 from VP1__Norovirus_and/or_Norovirus-like__KT780375
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccaucuuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacauaacccauauuacaggcagccggaacuacaccaugaaucucgcaucucagaacugguccaauuaugaucccacggaggaaaucccugcuccacuggguacucccgacuucguugggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccagucggugugauccaggauggcaguacuacccacaggaacgagccccaacaguggguuuugccgucuuacuccgggcggaauacaccuaacgugcaccucgccccagcuguagcgcccaccuuuccuggagaacagcuguuauucuuucguagcacuaugcccggcuguucggguuauccaaauauggaccuggauugccuccuuccucaggaguggguccaauacuucuaucaggaggcagcccccgcucagucugacguggcccuguugcgcuuuguuaacccagauacggggagagugcuauucgaauguaagcugcauaaauccggcuacgucacaguggcacacaccggacagcaugaccucguaaucccgccuaauggcuauuuuagguucgauucaugggugaaccaauucuacacucuggcccccauggggaacggaaccggucggcgacgcuga

SEQ ID NO: 20957 - RNA, 1617 nt, Artificial Sequence
  derived and/or modified sequence opt3 from VP1__Norovirus_and/or_Norovirus-like__LC016607
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgaacacgcacacuuaccggaugaaucucgccagccagaacuggaauaacuaugaucccacagaggaaauuccugcaccacugggcacccccgacuucguagguaagauccaggggaugcuuacucagacaaccaagggagacggcucuacgcgcggccauaaggcuaccguuuccacagggucaguggauuuuacuccuaaacugggaagcguccaauucaccacagacacugauaaugacuuugagaccggucagaacacacgauucaccccagugggcgucauccaggaugggaauggagcccacagaaacgaaccccaacaguggguguugccggacuacaguggcgguacuguucacaaugugcaucucgcuccugccguagcaccaacguuucccggggagcagcuguuauucuuuaggucuacaaugccuggcuguuccggauaccccaacauggaucuggacugccuccuuccacaggaauggguccaacacuucuaucaggaggccgcuccugcgcagagcgauguggcacuguugcgguuuguuaaucccgacaccggccgugugcuauucgaguguaagcugcauaaaacuggguacgucaccguggcccacacaggacagcacgaucucguaauuccaccgaacgguuauuuucgcuucgacucgugggugaaccaauucuacacccuggcuccuaugggcaauggggccggaagaaggcgguga

SEQ ID NO: 20958 - RNA, 1617 nt, Artificial Sequence
  derived and/or modified sequence opt3 from VP1__Norovirus_and/or_Norovirus-like__KP241915
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucgggccgacggcucaacacgcggccauaaggcuaccgucuacacggggagcgccgauuuugcaccuaagcugggacgagugcaauucgagaccgacacaaaccacgauuuugaagccaaucagaacacuaaauucaccccaguuggugugauccaggacggcgggacaacucacagaaaugagccccaacaguggguauugccgaguuacucuggaaggaacaccccuaauguccaucucgcuccagcgguggcacccacauuuccuggcgaacagcuguuauucuuucgguccaccaugcccgguuguagcggguauccaaacauggaucuggacugccuccuuccucaggaguggguucaauacuucuaucaggaggccgcucccgcccagucggauguggcacuguugcguuuugucaauccagacacuggccgcgugcuauucgaauguaagcugcacaaaucuggauacguaacgguggcccauacaggccagcacgaucucguuauuccgccuaacggguauuuuagauucgacuccugggucaaccaauucuacacccuggcucccaugggaaaugguacuggcaggcggcgauga

SEQ ID NO: 20959 - RNA, 1617 nt, Artificial Sequence
  derived and/or modified sequence opt3 from VP1__Norovirus_and/or_Norovirus-like__KM514065
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcuggauuugccccuaagcuggguagagugcaauucgagacagauacugaccaugauuuugaagcaaaccagaauaccaaauucacaccaguuggcgugauccaggacgggaguacuacccacaggaacgagccccaacaguggguauugccgucuuacuccggacggaauacaccuaacguccaccucgccccagcuguggcgcccaccuuuccuggcgaacagcuguuauucuuucguagcacuaugcccgguuguucgggguauccaaauauggaucuggacugccuccuuccucaggaguggguucaauacuucuaucaggaggcagcccccgcucagucugauguggcccuguugcgcuuugucaacccagacacgggcagagugcuauucgaauguaagcugcauaaauccggauacguaacaguggcacacaccggccagcaugaucucguuauuccgccuaauggguauuuuagguucgacucaugggucaaccaauucuacacucuggcccccaugggaaacgguaccggccggcgacgcuga

SEQ ID NO: 20960 - RNA, 1617 nt, Artificial Sequence
  derived and/or modified sequence opt3 from VP1__Norovirus_and/or_Norovirus-like__KM268097
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuugccccuaagcugggacgagugcaauucgagacagacacuaaucacgauuuugaagcaaaccagaauaccaaauucacaccaguuggugugauccaggacggcgggacuacccacagaaacgagccccaacaguggguauugccgagcuacaguggaaggaauacaccuaacguccaucucgccccagcuguggcgcccaccuuuccuggcgaacagcuguuauucuuucggucuacuaugcccgguuguuccggguauccaaauauggaucuggacugccuccuuccucaggaguggguucaauacuucuaucaggaggcagcccccgcucagagcgauguggcccuguugcguuuugucaacccagacacgggccgcgugcuauucgaauguaagcugcacaaaucgggauacguaacaguggcacauaccggccagcacgaucucguuauuccgccuaacggguauuuuagauucgacucuugggucaaucaauucuacacucuggcccccaugggaaacgguaccggcaggcggcgauga

SEQ ID NO: 20961 - RNA, 1617 nt, Artificial Sequence
  derived and/or modified sequence opt3 from VP1__Norovirus_and/or_Norovirus-like__KM268084
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacuggccaggccgaguccugauuuugacuucauuuuucucgugcccccaaccgucgaaucccggacaaaaccuuucucugugcccguuuuaaccguggaggaaaugacuaauagccgcuuuccaaucccccuggagaaacuuuucacaggaccuuccucagcauucgucgugcagccacagaacgguagauguaccacggauggcguauugcuggggacuacccaacuaaguccgguuaauauuugcacauuuaggggagacgugacucauaucaccggcagccggaacuacacaaugaaucucgcuucucagaacugguccaauuaugaucccaccgaggaaauaccugccccacuggguacgcccgacuucgucgggaagauucagggagugcuuacucagacaaccaagacugacggcucaacacgcggccacaaggcuaccgucuacacggggagcgccgauuuugcaccuaaacugggacgagugcaauucgagaccgacacagaucaugacuuugaagccaaccagaauacuaaguucaccccaguuggugugauccaggauggcaguacaacucacagaaacgagccccaacaguggguauugccgucuuacuccgggaggaauaccccuaacguccaccucgcuccagcgguggcacccacauuuccuggagaacagcuguuauucuuucggagcaccaugcccggcuguucggguuauccaaauauggaccuggauugccuccuuccucaggaguggguucaauacuucuaucaggaggccgcucccgcccagucugacguggcacuguugcguuuugucaacccagauacugggcgcgugcuauucgaauguaaacugcauaaguccggcuacguaacgguggcccacacaggacagcaugaccucguuauuccgccuaauggcuauuuuagauucgauucaugggucaaccaauucuacacccuggcucccauggggaacggaacugguaggcggcgauga

SEQ ID NO: 20962 - RNA, 1617 nt, Artificial Sequence
  derived and/or modified sequence opt3 from VP1__Norovirus_and/or_Norovirus-like__KJ649704
augaagauggccagcuccgacgcuaaccccucugauggcucagcagccaaucuggugccugaggucaacaaugaaguucucgcgcuugagccagugguaggggcugccaucgcagccccgguggcuggacagcaaaacgucauugaccccuggauaagaaauaacuucgugcaggcaccugguggcgaauuuaccguuaguccaaggaaugcccccggggagauccuguggagcgcuccuuugggaccagauuuaaaccccuaccugucccaccuagcccggauguauaauggcuacgcggguggguucgaagugcaggucauucucgcaggaaacgccuuuacagcuggcaaagugaucuucgccgcaguaccuccaaauuuuccgacugagggccugucucccucgcagguuacgauguucccucauauuguggucgacgugcgccaacuugagccagugcugauccccuugccugauguccgaaacaauuuuuaucacuacaaccagucaaaugacccaaccauaaagcucaucgcuaugcuguauacaccccugcgugccaacaacgcgggggaugacguuuucacugugagcugcagaguacucaccaggccgaguccugauuuugacuucaucuuuuuagugcccccaacagucgaaucccggaccaaaccuuucucugugcccguucugacuguggaggaaaugacaaauagccgcuuuccaauuccccuugagaaguuguucaccggaccuuccucagccuucgucgugcagccacagaacgguagauguacgacugauggcguacugcuagggaccacacaacucaguccgguuaauauuugcacuuuuaggggagacgugacccauaucacaggcagccacaacuacaccaugaaucuggcaucucagaacuggaauaacuaugaucccacggaggaaauaccugcuccacuugguacucccgacuucgucgggaaaauucagggagugcugacacagaccacucggacagacggcuccacccgcggccauaaggccacggucuacaccgggucagcugauuuuagcccuaaguugggacgaauccaauucgagacagacacuaaucacgauuuugaagccaaccagaauaccaaauucacaccaguggguguuauucaggacggcgggacuacccacagaaacgagccccaacagugggugcucccgaguuacucuggaaggaauacaccuaacguacaucuggcaccagccgucgcucccaccuuuccuggcgaacaguuacuguucuuucgguccacuaugcccgguuguagcggguauccaaauauggaucucgacugccuucugccucaggagugggugcaauacuucuaucaggaggcggcacccgcccagucggauguugcuuugcuacguuuugugaacccagacacgggccgcguccuguucgaauguaagcuccacaaaucuggauacgugacaguagcccauaccggccagcacgaucuggugaucccgccuaacggguauuuuagauucgacuccuggguuaaucaauucuacacucuugcacccaugggaaacgguaccggcaggcggcgauga

SEQ ID NO: 20963 - RNA, 1617 nt, Artificial Sequence
  derived and/or modified sequence opt3 from VP1__Norovirus_and/or_Norovirus-like__KC577174
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcuccucaaacuacaccaugaaucucgccagccagaacuggaauaguuaugauccgacggaggaaauccccgcaccucuggguacuccagacuucguugggaagauucagggagugcuuacacagaccacucggacagacggcucuacccgcggccacaaggcuacggucuacaccggguccgccgauuuuagccccaagcugggacgagugcaauucgcuacagacacugauaacgacuuugagaccaaucagaacacaaaauucacuccugucggugugauccaggauggcgccaccacacauagaaaugaaccacaacaguggguuuugcccucguacucugggaggaacacccacaaugugcaccucgcaccggccguagcuccuacuuuuccaggagagcagcuguuauucuuucgguccacgaugcccggcuguucagguuauccuaacauggaccuggauugccuccuuccccaggaauggguccaauacuucuaucaggaggcggcaccagcccagagugacguggcucuguugcguuuuguuaauccugauacagggcgcgugcuauucgaguguaagcugcauaaaagcggcuacgucaccguggcccacacuggacagcaugaccucguaauucccccaaacggcuauuuuagauucgauuccugggugaaccaauucuacacccuggcaccgauggggaauggaacagguaggcggcgauga

SEQ ID NO: 20964 - RNA, 1617 nt, Artificial Sequence
  derived and/or modified sequence opt3 from VP1__Norovirus_and/or_Norovirus-like__KF177451
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugauaaugacuuugaagcaaaccagaauaccaaauucacaccaguuggugugauccaggauggcgggacuacccauaggaacgagccccaacaguggguauugccgagcuacaguggacggaauacacacaacguccaccucgccccugcuguggcgccaaccuuucccggcgaacagcuguuauucuuucguucuacuaugccugguuguuccggguaucccaauauggaccuggauugccucauuccacaggaguggguucaauacuucuaucaggaggcagccccugcucagagcgacguggcccuucugcgcuuugucaaccccgauacgggcagaguguuguucgaauguaagcuacauaaaucgggauacguaacaguggcacacaccggccagcaugaccugguuaucccaccgaacggguauuuuagguucgauucuugggucaaucaauucuacacucucgccccuaugggaaacgguaccggccggcgacgcuga

SEQ ID NO: 20965 - RNA, 1617 nt, Artificial Sequence
  derived and/or modified sequence opt3 from VP1__Norovirus_and/or_Norovirus-like__KF177429
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacaccuaauguccaccucgccccagcuguggcgcccaccuuuccuggcgaacagcuguuauucuuucguucuacuaugcccgguuguuccggguauccaaacauggaccuggauugccuccuuccucaggaguggguucaauacuucuaucaggaggcagcccccgcucagagcgacguggcccuguugcgcuuugucaauccagauacgggcagagugcuauucgaauguaagcugcauaaaucgggauacguaacaguggcacacucuggccagcaugaccucguuauuccgccuaacggguauuuuagguucgauuccugggucaaccaauucuacacccuggcccccaugggaaaugguacuggccggcgacgcuga

SEQ ID NO: 20966 - RNA, 1617 nt, Artificial Sequence
  derived and/or modified sequence opt3 from VP1__Norovirus_and/or_Norovirus-like__KF060005
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuacaccuaagcugggaagagugcaauucgcuacugacaccgauaaugacuuugucacaaaucagaacacuaaauucaccccaguggguguuauccaggauggcucuacaacccccaggaaugagccgcaacaguggguguugccuuccuacagcgggcggaacacucauaauguacaccucgccccagcagucgcccccacguuuccuggagaacagcuguuauucuuucguucgacaaugcccggcuguucugguuauccaaacauggaccuggauugccuccuuccucaggagugggugcaauacuucuaucaggaagcugcgcccgcacaguccgacguugcccuguugcgcuuugugaauccagauaccgggagaguccuauucgaguguaagcugcacaaaucaggcuacgugacuguagcucauaccggacagcacgaccucgugaucccgccuaacggcuauuuuagguucgauaguuggguuaaccaauucuacacacuggcccccauggggaauggaaccggucggcgacgcuga

SEQ ID NO: 20967 - RNA, 1617 nt, Artificial Sequence
  derived and/or modified sequence opt3 from VP1__Norovirus_and/or_Norovirus-like__JX439821
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuucuagcucccggaacuacaccaugaaucucgccucacagaacuggagcaguuaugaucccacggaggaaaucccugcaccacugggcacucccgacuucguugguaagauucagggggugcuuacacagaccacucgcacagacggaucuacccgaggccacaaggcuacggucuacaccggcuccgccgauuuuagcccuaagcuggggagagugcaauucgacacagauacugacaaugauuuugagaccaaccagaauacaaaauucacuccagucggagugauccaggacgguucgaccacauacaggaacgaaccccaacaguggguuuugccgucuuauuccggccggaauacccauaacgugcaccucgcuccugccguagcaccaacuuuucccggggagcagcuguuauucuuucguucaacgaugccuggauguaguggcuaccccaauauggaucuggacugccuccuuccacaggaauggguccaauauuucuaccaggaggccgcuccugcgcagagcgauguggcacuguugcgcuuuguuaaccccgacacagguagagugcuauucgaguguaagcugcacaaauccggguaugucaccguggcccauacuggccagcacgaucucguaaucccaccgaauggauacuuuagguucgacucuugggugaaccaauucuauacccuggcuccuaugggcaacgggacaggacggcgacgcuga

SEQ ID NO: 20968 - RNA, 1617 nt, Artificial Sequence
  derived and/or modified sequence opt3 from VP1__Norovirus_and/or_Norovirus-like__KC517361
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacaucacccauauaacaggcagccggaacuacaccaugaaucucgcaucucagaacuggaauaacuaugaucccacggaggaaauuccugcuccacuggguacucccgacuucguggggaagauccagggaguccuuacacagaccacucgcacagacggcuccacccgaggccacaaggccacggugcauaccgggucagcugauuuugccccuaagcugggaagaguccaauucgagacagacacugaucacgacuuugaagcaaaucagaacaccaaauucacaccaguggguguuauucaggauggcgggacuacccacaggaaugagccccaacaguggguguugccgagcuacaguggacggaacacacauaauguacaccucgccccugcugucgcgccaaccuuucccggcgaacagcuguuauucuuucguucuacuaugccugguuguuccggguaccccaacauggaccuggauugccuccuuccacaggagugggugcaauauuucuaccaggaggcagccccugcucagagcgacguugcccuguugcgcuuugugaaucccgauacgggcagaguccuauucgaauguaagcugcauaaaucgggauaugugacaguagcacacaccggccagcacgaccucgugaucccaccgaacggguacuuuagguucgauucuuggguuaaccaauucuauacucuggccccuaugggaaaugguaccggccggcgacgcuga

SEQ ID NO: 20969 - RNA, 1617 nt, Artificial Sequence
  derived and/or modified sequence opt3 from VP1__Norovirus_and/or_Norovirus-like__KC175378
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugagucucgcuagccugaauuggaacaauuaugacccgacugaagagauucccgccccucuugggacaccagauuucguaggaaagauccagggcguucugacccagacuacaaagggcgacgggucuacccgcggacacaaggcuacgguguacaccgguuccgcccccuuuacaccuaaauugggcucaguccaguucagcacugacaccgaaaacgauuuugagacacaucaaaauacuaaguucaccccagugggggucauccaggacggaggcacaacccaccgaaacgaaccccagcaaugggugcucccgaguuacucugguagagauguucacaaugugcaucuggccccugcaguagcuccaacuuuucccggggagcaguuacuguucuuuagguccacgaugccuggcuguagcggauaucccaacauggaccucgauugccuucugccacaggaguggguccagcacuucuaccaagaagcggccccugcacagucggacguggcuuugcuacgguuuguuaaucccgauacaggccgugugcuguucgaguguaaacuccauaagucuggguaugucaccguggcccacacuggacagcacgaccugguaauuccaccgaacgguuacuuucgcuucgauuccugggugaaucaguucuauacccuugcaccuaugggcaacgggacaggaagaaggcgguga

SEQ ID NO: 20970 - RNA, 1617 nt, Artificial Sequence
  derived and/or modified sequence opt3 from VP1__Norovirus_and/or_Norovirus-like__JX459648
augaagauggccagcaacgacgcuaaucccuccgagggcucugcagccaaccuggugccugaagucaauaacgagguuauggcgcucgaaccagugguaggggcugccaucgcagccccgguggcuggacagcaaaaugucauugaucccuggauaagaaacaauuucgugcaggcaccugguggcgaguuuaccguuucaccaaggaacgcccccgggacaauccgguggagugcuccucuuggaccagaccugaaucccuacuugagccacuuagcccgcauguauaacggcuacgcggguggguucgaagugcaggucauucuggcaggaaaugccuuuacugcuggcaaaaucauuuucgccgcagugccuccaaacuuuccgacggagggccuaucccccucucagguaaccauguucccucauaucauaguugaugugcgacaacucgagccaguccugaucccccuuccugacgugcguaauaacuuuuaucacuacaaucagucgaacgauucaacaauuaagcugaucgcuauguuguauacuccacucagagccaacaaugcgggggaagacguguucaccgucagcugcaggguucugacacggcccaguccggauuuugacuucauuuuucuggugccucccaccguagagucccgcacuaaaccauucacagugccuauccucaccgucgaagagaugacgaacucuagauuuagcauacccuuagagaagcuguucacuggaccauccggugccuucgugguucagccccagaaugggagguguaccacagauggcgugcuuuugggaacuacccaacugucaccugucaacauuugcacauuucggggcgacgugacccauaucgcagguagucgcaauuacacgaugaaccuagcugcccucaauuggaacaauuaugauccaacugaagagauuccggcuccccuggggacaccugacuucguaggaaaaauccagggcguucuuacccagacuacaaagggcgaugggagcacccgaggacacaaggccacgguguacaccgguucugcagacuuuacaccaaaacugggcuccguccaguucucaacugacaccgaaaacgauuuugagagccaucaaaauacaaaguucacucccgugggggucauccaggacggaaguaccacacacagaaacgaaccucagcaauggguguugccaucuuacuccggcaggaauguucacaacgugcaucucgcccccgcuguagcgccgaccuuuccuggugagcagcuguuauucuuucggagcacuaugccaggguguucgggcuaucccaauauggaucuggacugccucauuccucaggaguggguccagcacuucuaccaagaagcagcccccgcucagucugauguggcccuucugcguuuuguuaacccagacacgggacgcguguuguucgaguguaaacuacauaaguccggcuaugucacaguggcacacaccgggcagcacgaucugguaauaccucccaacggauacuuuagauucgacucaugggugaaucaguucuauacucucgccccaauggguaacggcgcugggaggcggcgauga

SEQ ID NO: 20971 - RNA, 1617 nt, Artificial Sequence
  derived and/or modified sequence opt3 from VP1__Norovirus_and/or_Norovirus-like__JX459635
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauacuggacguucgccaacuugagccagugcugauccccuugccugauguccgaaauaacuuuuaucacuacaaucagucgaacgacucaaccauuaagcucaucgcuaugcuguauacaccacugcgugccaacaaugcgggggaagauguguucacugugagcugcagaguccucaccaggcccaguccggacuuugauuucauuuuucugguuccucccacaguggagucccggaccaaaccauucacuguaccuauccugacaguggaagagaugaccaacucucgcuuucccauaccacuugagaaguuguucacgggacccagcggugccuucgucgugcagccucagaauggcagauguacuaccgacgggguucugcuaggaacaacucaacucuccccagugaacauuugcaccuuuaggggcgaugucacacauaucgcagguucacggaauuacaccaugaaccuggcuagucuuaauuggaacaauuaugacccgacggaagagauucccgccccucuggggacuccagauuucgugggaaaaauccagggcguauugacacagaccacuaagggcgacgggagcacacgcggacacaaggcuaccguuuacacggguucugcccccuuuaccccuaaacucggcuccgugcaguucucaacagacacugaaaacgauuuugagacccaucaaaauacaaaguucacuccagucggggugauccaggacggaagcaccacacgaagaaacgaaccccagcaauggguccugccgaguuacucuggcaggaaugcacacaacgugcacuuagccccugcuguugcgccaaccuuucccggugagcaguuacucuucuuucgguccacuaugccuggguguagcggcuaucccaauauggaucuugacugccuguugccacaggagugggugcagcauuucuaccaagaagcagccccugcucagucggauguagcccuacugcguuuugucaaccccgacacgggacgcguucucuucgaguguaaacugcacaagucuggcuaugugacaguggcacauaccgggcagcacgaucuugucauuccaccgaacggauacuuuagauucgacuccugggugaaucaguucuauacucuggccccuauggguaacggcaccgggaggcggcgauga

SEQ ID NO: 20972 - RNA, 1617 nt, Artificial Sequence
  derived and/or modified sequence opt3 from VP1__Norovirus_and/or_Norovirus-like__JX459624
augaagauggccagcaacgacgcucaccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuucaccaaggaaugcccccggggagauccuuuggagugcuccucugggaccagauuugaaccccuacuuaagccaucuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucacaucauaguugacgugcgccaacuggagccaguccuuaucccccugccugaugugcgaaacaauuuuuaucauuacaaccagucgaaugacucaaccauuaaguugaucgcuaugcucuauacaccacugcgugccaacaacgcgggggaagauguguucacugucagcugcagaguucugaccaggcccaguccggacuuugauuucauuuuucucgugccucccacaguagagucccggaccaaaccauucacugugccuaucuuaacagucgaagagaugaccaauucucgcuuucccauaccacuggagaaacuuuucacgggacccagcggugccuucgugguucagccucagaacggcagauguacuaccgacgggguguugcugggaacaacucaacuauccccagucaauauuugcaccuuuaggggcgaugugacacacaucgcagguacccggaacuacacgaugaaucucgcuucacugaacuggaauaacuaugacccgacugaagagauucccgccccucuugggccacccgauuucguaggaaagauccagggcguucugacacagaccacuaagggcgacgggaguacacgcggacauaaggcuaccguguacacggguagcgccccuuuuaccccaaaauugggcucuguccaguucuccacagacacugaaaaugauuuugagacccaccaaaacacaaaguucacucccgugggggucauccaggacggaggcaccacacaccgaaaugaaccgcagcaaugggugcucccuucauacagcgguagaaacguucauaaugugcaccuggcaccagccguagcucccaccuuuccuggggagcaguuacuguucuuuaggaguacuaugcccggcuguucuggauauccaaacauggaucucgacugccuucugccucaggaguggguccagcauuucuaccaagaagcggcacccgcccaguccgauguggcuuugaugcgguuuguuaauccagacacgggccgugugcuauucgaguguaaacugcacaagagcggguaugucacaguggcccacaccggacagcaugaucucguaauuccgccuaacgguuacuuucgcuucgacucgugggugaaccaguucuauacucuggcacccaugggcaaugggaccggaagaaggcgguga

SEQ ID NO: 20973 - RNA, 1617 nt, Artificial Sequence
  derived and/or modified sequence opt3 from VP1__Norovirus_and/or_Norovirus-like__JX459614
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaggcaccacacaccgaaacgaaccccagcaaugggugcucccgagcuacagugguagaaauguucacaacgugcaucuggccccugcaguagcuccaaccuuucccggggagcaguuacuguucuuuaggucuacuaugccuggcuguuccggauaucccaauauggaucucgacugccuucugccacaggaguggguccagcacuucuaccaagaagcggccccugcacaguaugauguggcuuugcuacgguuuguuaaccccgacacgggccgugugcuguucgaguguaaacuccauaagagcggguacgucacaguggcccacaccggacagcacgaucugguaauuccaccgaacgguuauuuucgcuucgacucgugggugaaucaguucuacacucuugcaccuaugggcaacgggaccggaagaaggcgguga

SEQ ID NO: 20974 - RNA, 1617 nt, Artificial Sequence
  derived and/or modified sequence opt3 from VP1__Norovirus_and/or_Norovirus-like__HM635103
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuggagaccaaccagaauacaaaauuuacucccgucggugugauccaggacggcucuaccacaccgaggaacgaaccucaacaguggguucucccauccuacagcgggcggaauauccauaacgugcaccuggcccccgcaguagccccuaccuuccccggagagcaguuacuguuuuuccguucgacuaugccaggcuguucugguuauccuaauauggaucucgacugccuucugccccaggaauggguccaauacuuuuaucaggaggcugcgccagcacaguccgauguggccuugcuacgcuucguuaacccggacacggggagagugcuguuugaguguaagcuccacaaaucaggcuacgucacaguggcucauaccggacagcacgaucugguaauuccucccaacggcuauuucagguuugacaguugggugaaucaauucuacacucuugccccaauggggaacggaaccggucggcgacgcuga

SEQ ID NO: 20975 - RNA, 1617 nt, Artificial Sequence
  derived and/or modified sequence opt3 from VP1__Norovirus_and/or_Norovirus-like__JQ613522
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucgggacuacaccaugaaccucgcuagccugaauuggaacaauuaugauccgacggaagagauucccgccccucuugggacuccagacuucguaggaaagauccagggcaugcugacacagaccacuaagggcgacgggucuacacgcggacacaaggcuaccguuuacacggguuccgcccccuuuaccccuaaauugggcucagugcgauucagcacagauacugaaaacgacuuugagacccaucagaauacaaaguucacuccagucggggugauccaagauggaaguaccacacacagaaacgaaccccagcaguggguccucccgucuuacuccggcagggacgugcacaauguucaucuggccccugcaguggcuccaaccuuucccggugagcaauuacuguucuuucggagcacuaugccuggguguucgggcuaucccaacauggaucucgacugccuucugccacaggaguggguacagcacuucuaccaggaagcggccccugcacaaucugaugucgcuuugcuacguuuugugaaucccgacacgggacgcguucuguucgaguguaaacuccauaaguccggcuaugugacagucgcccacaccgggcagcacgaucuggugauuccaccgaacggauacuuuagauucgacucauggguaaaucaguucuauacucuugcaccuauggguaacggcaccgggaggcggcgauga

SEQ ID NO: 20976 - RNA, 1617 nt, Artificial Sequence
  derived and/or modified sequence opt3 from VP1__Norovirus_and/or_Norovirus-like__AB629942
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacucaaaacgauuuugaaacccaucagaauacaaaguucacuccagugggcgucauccaggacgggggaaccacacaccgaaacgagccccaacagugggugcucccgaguuacucuggcagaaauguuccuaacgugcaccuggcaccagccguagcucccaccuuuccuggugaacaguuacuguucuuuagguccacuaugcccggguguagcggcuauccaaauauggaucucgacugccuucugccucaggaguggguccaacauuucuaccaggaggcggcacccgcccagucggauguggcuuugcuacgguuuguuaacccagacacgggacgugugcuguucgaauguaaacuccacaagucucgcuaugucacaguggcccauaccggccagcacgaucugguaauuccgccuaacggguacuuuagauucgacuccugggugaaucaauucuauacucuugcacccaugggaaacgguaccggcaggcggcgauga

SEQ ID NO: 20977 - RNA, 1617 nt, Artificial Sequence
  derived and/or modified sequence opt3 from VP1__Norovirus_and/or_Norovirus-like__GQ856457
augaagauggccagcaacgacgcuaaucccuccgauggcccugcagccaaccuggugccagaggucaauaacgaaguuauggcgcucgagccggugguaggggcugccaucgcagcccccguggcuggacagcaaaaugucauugacccuuggauaagaaacaauuucgugcaggcaccagguggcgaauuuaccguuucucccaggaacgccccuggggagauccuuuggucagcuccacugggacccgauuugaauccuuacuuaagucaccuggcccggauguauaacggcuacgcggguggguucgaagugcaggucauucuagcaggaaaugccuuuacagcuggcaaaaucauuuucgccgcagugccaccgaacuuucccacugagggccucagcccuucccagguaacgauguucccacauaucauaguugacgugcgccaacuggagcccguccuuaucccucugccagaugugcgaaauaacuuuuaucacuacaaucagucuaacgacucgaccauuaaguugaucgcuaugcucuauacaccccugcgugccaacaaugcgggggaagauguguucacugucucaugcagaguucugaccaggccgagcccugacuuugauuucauuuuucucgugcccccaacaguagagagucggaccaaaccuuucacugugcccaucuuaacagucgaagagaugaccaacucccgcuuuccaauaccccuggagaaacuuuucacgggaccuucuagcgccuucgugguucagccacagaaugguagauguacuaccgacggcguguugcuggggacaacucaacuauccccggucaacauuugcaccuuuaggggagaugugacacauaucgcaggcucaaguaauuacaccaugaaccucgcuagccugaauuggaacaauuaugaccccacggaagagauuccugccccacuugguacucccgauuucguagggaagauccagggaguucugacacagaccacuaagggcgacggcucuacacgggggcacaaggcuaccguguacacgggauccgccccuuuuaccccaaaauuggguucaguccaguucagcacagacacucaaaacgauuuugaaacccaucagaauacaaaguucacucccgugggcgucauccaggacgggggaaccacacaccgcaacgagccgcaacagugggugcucccuaguuacucuggccgaaauguucagaacgugcaccuggcaccagccguagcucccaccuuuccuggugaacaguuacuguucuuuagauccacuaugcccggguguagcggcuauccaaauauggaucucgacugccuucugccucaagaguggguccagcauuucuaccaggaggcggcacccgcccagucggauguggcuuugcuaagguuuguuaacccagacacgggacgggugcuguucgaauguaaacuccacaagucucguuaugucacaguggcccauaccggccaacacgaucugguaauuccgccuaacggguacuuucgcuucgacuccugggugaaucaguucuauacucuugcacccaugggaaacgguaccggcagaaggcgguga

SEQ ID NO: 20978 - RNA, 1617 nt, Artificial Sequence
  derived and/or modified sequence opt3 from VP1__Norovirus_and/or_Norovirus-like__EU876883
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccaugucaccucauaucauaguugacgugcgccaacuggagccaguccuuaucccccugccugaugugcgaaacaauuucuaucacuacaaccagagcaaugacccaacaauuaaguugaucgcaaugcucuauacuccccugcgugcuaacaacgccggggaugacguguuuaccgucaguugcagaguucugacaaggccguccccugauuucgacuuuauuuuccucgugcccccaaccguagaaucucggacuaaaccuuuuagcgugcccaucuuaacagucgaggaaaugaccaauucccgcuucccaauaccccuggagagacuuuuuacgggaccuucaagugcguucgugguucagccacagaacgguagguguacuaccgauggcguguugcuggggacaacucaacuaagcccggucaauauuugcaccuuccggggagacgugacacauaucgccggcacccaggaguacacgaugaaccucgcaucucagaauuggaacaauuaugaucccacugaagagauuccugcuccacuggguacacccgacuuuguagggaagauccagggaguucuuacccaaacuacacgccgagacggcuccaccagaggccacaaagccacggugucaaccgggagcguccauuucacaccuaagcugggaaggauccaguuuaguacugauaccucuaacgacuucgaaacaggucagaauacucgguuuaccccagugggcgucgugcaagaugggggaacaacccaccagaacgagccccagcaguggguuuugccgaauuacuccggccgugacggucacaacgugcaucucgcuccugccguagcacccagcuucccaggggaacaacuguuauuuuuccgcucgacuaugccuggcuguucuggauaccccaauaugaaccuggauugccuccuuccacaggaguggguccagcacuuuuaucaggaggccgcuccugcgcaauccgacguggcacuguugagauucguuaaucccgauacgggcagggugcuauuugaauguaagcugcauaaaucaggguacgucacaguggcccacaccggacagcacgaccucguaauuccaccgaacgguuauuuccgguuugauaguugggugaaccaguucuacacucuggcuccuaugggcaaugggaccggacgacgcagauga

SEQ ID NO: 20979 - RNA, 1617 nt, Artificial Sequence
  derived and/or modified sequence opt3 from VP1__Norovirus_and/or_Norovirus-like__AB447455
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguacccggaauuacacgaugaaccucgcuucacugaguuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagaaacguucacaaugugcaucuggccccugcaguagcuccaacuuuucccggggagcaguuacuguucuuuaggucuacgaugccuggcuguuccggauaucccaacauggaucucgacugccuucugccacaggaguggguccagcacuucuaccaagaagcggccccugcacagagcgauguggcuuugaugcgguuuguuaaucccgacacaggccgugugcuauucgaguguaaacugcauaagucgggguaugucaccguggcccacacuggacagcacgaucucguaauuccaccgaacgguuacuuucgcuucgacucuugggugaaccaguucuauacccuggcaccuaugggcaaugggacaggaagaaggcgguga

SEQ ID NO: 20980 - RNA, 1617 nt, Artificial Sequence
  derived and/or modified sequence opt3 from VP1__Norovirus_and/or_Norovirus-like__EU078409
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccagauucacaccagucggagugguccaggauggcaacgguacccaccaaaaugagccccagcaguggguguugccgucuuacuccgggaggacuggccauaacguucaccucgcuccugccguggcaccaacguuucccggagaacagcuguuauucuuucggucaacaaugccuggcuguagcggguaccccaacaugaaucuggacugccuccuuccacaagaguggguacagcauuucuaucaggaggccgcuccugcgcagagugaugucgcacuguugcguuuugugaaccccgacaccggacgcguucuauucgaauguaagcugcacaaaucugguuacgugacugucgcccacaccggccaacaugaucucgugauuccaccgaauggguauuuuagauucgacuccuggguaaaccaguucuacacacuggcuccuaugggaaauggcaccgguaggcggcgauga

SEQ ID NO: 20981 - RNA, 1617 nt, Artificial Sequence
  derived and/or modified sequence opt3 from VP1__Norovirus_and/or_Norovirus-like__AB303928
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacacucaggggcgaugugacccauaucgccgguacgcacaauuacacuaugaaccuggcaucccagaauuggaacaauuaugaccccacagaagagauuccugcuccacuugggacccccgauuuuguaggacggauccagggcguucugacucagacaacccgcggcgacgggucaacgcgaggacauaaggccaccgugaguacaggugacguccacuucacuccuaaguugggcagcgugcaauuuaacaccgauacaaauaacgacuucgaaaucgggcagaauacuagauuuaccccagucggagugguucaggauggcaacgguacacaccaaaaugagccccagcagugggugcucccgucuuacuccgggaggaccggccauaacguacaccuggcuccugccgucgcaccaacuuuccccggagaacaguuacuguuuuuccggucaacgaugccuggcuguagcggguaccccaacaugaaucucgacugccuucugccacaagagugggugcagcauuuuuaucaggaggccgcuccugcgcagagugauguugcauugcuacguuucgugaaccccgacacaggacgcguccuguuugaauguaagcuccacaaaucugguuacgugaccguagcccacacuggccaacaugaucuggugauuccaccgaauggguauuucagauuugacuccuggguuaaccaguucuacacccuugcuccuaugggaaauggcacagguaggcggcgauga

SEQ ID NO: 20982 - RNA, 1617 nt, Artificial Sequence
  derived and/or modified sequence opt3 from VP1__Norovirus_and/or_Norovirus-like__AY502023
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucaguugaacgacccaacaauuaagcucaucgcaaugcuguauacuccccugcgugcuaacaaugccggggaagauguguucaccgucucgugcagaguucucacaaggccgucaccugacuuugauuucaucuuuuuagugcccccaaccguagagagccggacuaaaccuuucacagugcccauucugaccgucgaagagaugacgaacagucgcuuuccaauaccccuugagaaguuguucacuggaccuuccggugcguucgugguucagccacagaauggcagauguaccacagacggggugcugcuaggaacuacccaacucucuccggucaacauuugcacauuuaggggcgaugugacccauaucgccgguacgcacaauuacacuaugaaccuggcaagccagaauuggaacaauuaugaccccacagaagagauuccugcuccacuugggacccccgauuucguaggacggauccagggcaugcugacucagacaacccgcggcgacggguccacgcgaggacauaaagccaccguuucaacaggugacgugcacuuuacuccuaaguugggcaguauccaauucaacaccgauacaaauaacgacuuugaaacugggcagaauaccaaguucacaccagucggagugguccaggauggcaacgguacccaccaaaaugagccccagcagugggugcucccgagcuacucugggagaacuggccauaacguucaccuggcuccugccguggcaccaacguuucccggagaacaguuacuguucuuuagguccacaaugccuggcuguucaggguaccccaacaugaaucucgacugccuucugccacaagaguggguacagcauuucuaucaggaggccgcuccugcgcagagcgaugucgcauugcuacgguuugugaaccccgacaccggacguguucuguucgaauguaaacuccacaagagugguuacgugacugucgcccacaccggccaacaugaucuggugauuccaccgaauggguauuuucgcuucgacucuuggguaaaccaguucuacacacuugcuccuaugggaaauggcaccgguagaaggcgguga

SEQ ID NO: 20983 - RNA, 1617 nt, Artificial Sequence
  derived and/or modified sequence opt3 from VP1__Norovirus_and/or_Norovirus-like__KU678202
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggaaugcuuacacagaccacucggacagacggcucaacccgcggccauaaggccacgguguacaccgggagcgcugauuuugccccuaagcugggacgaguccaauucgagacagacacuaacaaugauuuugaagcaaaccagaauaccaaauucacaccaguggguguuauccaggacggcgggacuacccacagaaacgagccccaacaguggguguugccgaguuacucuggaaggaauacaccuaacguacaccucgccccagcugucgcgcccaccuuuccuggcgaacagcuguuauucuuucgguccacuaugcccgguuguagcggguauccaaauauggaucuggacugccuccuuccucaggagugggugcaauacuucuaucaggaggcagcccccgcucagucggauguugcccuguugcguuuugugaacccagacacgggccgcguccuauucgaauguaagcugcauaaaucuggauacgugacaguagcacacaccggccagcaugaucucgugauuccgccuaacggguauuuuagauucgacuccuggguuaaucaauucuacacucuggcccccaugggaaacggugcuggcaggcggcgauga

SEQ ID NO: 20984 - RNA, 1617 nt, Artificial Sequence
  derived and/or modified sequence opt3 from VP1__Norovirus_and/or_Norovirus-like__KX371607
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcgggacuacccaucggaacgagccccaacaguggguauugccgaguuacucuggacguaauacaccuaacguccaccucgccccagcuguggcgcccaccuuuccuggcgaacagcuguuauucuuucgcuccacuaugcccgguuguagcggguauccaaauauggaccuggauugccuccuuccucaggaguggguucaauacuucuaucaggaggcagcccccgcucagucggacguggcccuguugagauuugucaacccagauacgggcagggugcuauucgaauguaagcugcacaaaucuggauacguaacaguggcacauaccggccagcacgaccucguuauuccgccuaauggguauuuucgguucgauuccugggucaaccaauucuacacucuggcccccaugggaaacgguaccggccgacgcagauga

SEQ ID NO: 20985 - RNA, 1617 nt, Artificial Sequence
  derived and/or modified sequence opt3 from VP1__Norovirus_and/or_Norovirus-like__KX354112
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcagcacuacccacaggaaugagccccaacaguggguauugccgaguuacucugggcggaacacacacaauguccaucucgccccugcuguggcgccaaccuuucccggagaacagcuguuauucuuucguuccacuaugccuggcuguagcgguuaucccaacauggaccuggauugccuccuuccacaggaguggguucaauacuucuaucaggaggcagccccugcucagucggacguggcccuguugcgcuuugucaaucccgauacggggagagugcuauucgaauguaagcugcacaaaucuggcuacguaacaguggcacauauuggacagcacgaccucguuaucccaccgaacggcuauuuuagguucgauuccugggucaaccaauucuacacccuggccccuauggggaauggaacuggucggcgacgcuga

SEQ ID NO: 20986 - RNA, 1617 nt, Artificial Sequence
  derived and/or modified sequence opt3 from VP1__Norovirus_and/or_Norovirus-like__KX353993
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucgugcuagcgggaaaugcauuuacugccggcaaaauuaucuucgcugccguaccuccaaacuuuccgacggagggccucucgcccucacagguuaccauguucccucauauuaucguggacguccgccaacuggagccagugcuuauaccccugccugaugugcgaaauaacuuuuaucacuacaaucagagcaacgacccaacaaucaaguugauugcaaugcucuauacuccccugcgugcuaauaacgccggggaugacgucuucaccguuaguugcagagugcugacaaggccguccccugauuuugacuucaucuuucucguacccccaaccguggaaucucggacuaaaccuuucagcguccccguguuaacaguugaggaaaugaccaacucccgcuuuccaauuccccuggagaaacuuuucacgggaccuucaagugcguucgugguccagccacagaaugguagauguacuaccgauggcguguugcuggggacaacucaacuaagcccgguaaacaucugcaccuuuaggggagacguuacacauauacccggcucucggaauuacaccaugaaccucgccucccagaauuggaacucauaugauccuacggaggaaauuccagcaccccuggguacuccugacuucguggggaagauccagggaguccuuacacagaccacucgcacaaauggcagcacccgaggccacaaggcuacgguguacaccgggagugccgacuuuucuccaaagcugggaagaguccaauucgcuacagauacugacaacgauuuugagaccaaucagaacacaaaauucacucccguggguguuauucaggacggcgccaccacaccgaggaaugaaccucaacaguggguguugccauccuacagcgggcggaacauccauaauguacaccucgcacccgccgucgcuccuaccuuucccggagagcagcuguuauucuuucguucgacuaugccaggcuguucugguuauccuaacauggaucuggacugccuccuuccccaggaaugggugcaauacuucuaucaggaggcggcaccagcccaguccgauguugcucuguugcgcuuugugaauccggacacggggagaguccuauucgaguguaagcugcacaaaucaggcuacgugacaguagcccauaccggacagcacgaucucgugaucccucccaacggcuauuuuagguucgacaguuggguuaaccaauucuacacucuggcaccaauggggaauggaaccggucggcgacgcuga

SEQ ID NO: 20987 - RNA, 1617 nt, Artificial Sequence
  derived and/or modified sequence opt3 from VP1__Norovirus_and/or_Norovirus-like__KR131762
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcaugcugacacagaccacuaagggcgacgggucuacacgcggacacaaggcuaccguuuacacggguuccgcccccuuuaccccuaaauugggcucagugcaguucagcacagacacugaaaaugauuuugagacccaucaaaacacaaaguucacuccagucggggugauccaggacggaaguaccacacaccgaaaugaaccccagcaauggguccucccgucuuacuccggcagagaugugcacaacguucaucuggccccugcaguggcuccaaccuuucccggugagcaguuacuguucuuuaggagcacuaugccuggguguucgggcuaucccaauauggaccucgauugccuucugccacaggaguggguacagcacuucuaccaagaagcggccccugcacagucugacgucgcuuugcuacgguuugugaaccccgauacgggacguguucuguucgaguguaaacuccauaaguccggcuaugugacagucgcccacaccgggcagcacgaccuggugauuccaccgaauggauacuuucgcuucgauucauggguaaaccaguucuauacucuugcaccuauggguaacggcaccgggagaaggcgguga

SEQ ID NO: 20988 - RNA, 1617 nt, Artificial Sequence
  derived and/or modified sequence opt3 from VP1__Norovirus_and/or_Norovirus-like__AB972519
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacaccuaauguccaccucgccccagcuguggcgcccaccuuuccuggcgaacagcuguuauucuuucguucuacuaugcccgguuguuccggguauccaaacauggaccuggauugccuccuuccucaggaguggguucaauacuucuaucaggaggcagcccccgcucagagcgacguggcccuguugcgcuuugucaauccagauacgggcagagugcuauucgaauguaagcugcauaaaucgggauacguaacaguggcacacaccggccagcaugaccucguuauuccgccuaacggguauuuuagguucgauucuugggucaaccaauucuacacucuggcccccaugggaaaugguaccggccggcgacgcuga

SEQ ID NO: 20989 - RNA, 1617 nt, Artificial Sequence
  derived and/or modified sequence opt3 from VP1__Norovirus_and/or_Norovirus-like__AB972498
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggagcuggacugccuccuuccucaggaguggguucaauacuucuaucaggaagcagcccccgcucagucggauguggcccuguugcgcuuugucaacccagacacgggcagagugcuauucgaguguaagcugcauaaaucuggauacguaacaguggcacacaccggccagcaugaucucguuauuccgccuaauggguauuuuagguucgacuccugggucaaccaauucuacacucuggcccccaugggaaacgguaccggccggcgacgcuga

SEQ ID NO: 20990 - RNA, 1617 nt, Artificial Sequence
  derived and/or modified sequence opt3 from VP1__Norovirus_and/or_Norovirus-like__AB972488
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugugccuaagcugggaagaguucaauucgagacagacacugaucaugacuuugaagccaaccagaauaccaaauucacaccaguggguguaauccaggauggcaguacuacccacaggaacgagccccaacagugggucuugccgucuuacuccgggcggaauacaccuaacgugcaccucgcaccagccguugcucccaccuuuccuggagaacagcuguuauucuuucguagcacuaugcccggcuguucggguuauccaaauauggaccuggauugccuccuuccucaggagugggugcaauacuucuaucaggaggcggcacccgcccagucugacgucgcucuguugcgcuuugugaacccagauacggggagaguacuauucgaauguaagcugcauaaauccggcuacgugacaguugcccacaccggacagcaugaccucgucauuccgccuaauggcuauuuuagguucgauucaugggugaaccaauucuacacucuggcacccauggggaacggaaccggucggcgacgcuga

SEQ ID NO: 20991 - RNA, 1617 nt, Artificial Sequence
  derived and/or modified sequence opt3 from VP1__Norovirus_and/or_Norovirus-like__AB972483
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaaaccaaucagaacacaaaauucacuccaguuggugugauccaggauggcgggaccacacacaggaaugagccccaacaguggguauugccgagcuacaguggacggaacaccccuaauguccaccucgcaccagccguggcucccacuuuuccuggcgaacagcuguuauucuuucguucuacgaugcccgguuguuccggguauccaaacauggaccuggauugccuccuuccucaggaguggguucaauacuucuaucaggaggcggcacccgcccagagcgacguggcucuguugcgcuuugucaauccagauacaggcagagugcuauucgaauguaagcugcauaaaucgggauacguaaccguggcccacacuggccagcaugaccucguuauuccgccuaacggguauuuuagguucgauucuugggucaaccaauucuacacccuggcacccaugggaaaugguacaggccggcgacgcuga

SEQ ID NO: 20992 - RNA, 1617 nt, Artificial Sequence
  derived and/or modified sequence opt3 from VP1__Norovirus_and/or_Norovirus-like__KP864106
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacugaucacgacuuugaagcaaaccagaauaccaaauucacaccaguuggugugauccaggauggcgggacuacccacagaaacgagccccaacaguggguauugccgaguuacucuggaaggaauacaccuaacguccaucucgccccagcuguggcgcccaccuuuccuggcgaacagcuguuauucuuucgguccacuaugcccgguuguagcggguauccaaauauggaccuggauugccuccuuccucaggaguggguucaauacuucuaucaggaggcagcccccgcucagucggacguggcccuguugcguuuugucaacccagauacgggccgcgugcuauucgaauguaagcugcacaaaucuggauacguaacaguggcacauaccggccagcacgaccucguuauuccgccuaauggguauuuuagauucgauuccugggucaaccaauucuacacucuggcccccaugggaaacgguaccggcaggcggcgauga

SEQ ID NO: 20993 - RNA, 1617 nt, Artificial Sequence
  derived and/or modified sequence opt3 from VP1__Norovirus_and/or_Norovirus-like__KR904216
augaagauggccagcuccgacgcuaaccccucugauggcucaaccgcaaaucuggccccugaggugaacaaugaagucauggcgcucgagccaguugugggggcugccaucgcagccccgguagcuggacagaaaaacgugauugaccccuggauaagaaauaacuucguccaagcaccugguggcgaauuuacagugaguccaaggaaugcccccggggagauccuuuggagcgcuccucugggaccagauuugaaccccuacuuaucccaccuggcccggauguauaauggcuacgcggguggguucgaaguucaggugauucuagcaggaaacgccuuuacugcuggcaagaucauuuucgccgcagucccuccaaauuuuccgacggagggccucucucccucacaggugaccauguucccucauaucauaguagacguucgccagcuggagccagugcuuaucccccugccugauguccgaaacaauuuuuaucacuacaaccaaucgaaugacccaacaauuaaauugaucgcuaugcucuauacuccccugcgugccaacaacgcgggggaugacguguucaccgugagcugcagaguccugacaaggccgaguccugauuuugacuucauuuuucucguucccccaaccguggaaucccggacuaagccuuucucugcccccguauuaacaguggaggaaaugaccaauagccgcuuuccaaucccccuggagaaacuuuucacgggaccuuccucagcauucgucgugcagccacagaacgguagauguacuaccgauggcguuuugcuggggacaacucagcuaaguccggugaauauaugcaccuuuaggggagacgucacacauauuagcggcucucggaacuacaccaugaaucucgcuucccaaaacuggaacucauaugaucccacggaggaaaucccugccccacuggguacucccgacuucguggggaagauucagggaguacuuacacagaccacucgcacaaauggcagcacccgaggccacaaggcuacgguuuacaccgggagugccgacuuuucuccuaaacugggaagagugcaguucgcaacagauacugacaaugauuuugagaccaaccaaaauacaaaguucacuccagucggugugauccaggacggcuccaccacacccaggaacgaaccgcagcaaugggucuugccuagcuacucggggcggaauacccauaacgugcaccucgccccagcuguugcgcccacuuuuccuggagagcagcuguuauucuuucguucuacgaugcccggcuguuccgguuauccaaauauggaucuggacugccuccuuccucaggaaugggugcaguacuucuaucaagaggcagcccccgcucagucagauguagcccuguugcgcuuugucaacccagacacagggagagugcuauucgaguguaaacugcacaagaguggcuacguuaccguggcacauacuggacagagggaucucgucaucccgccuaacggcuauuuucgguucgacagcugggugaaucaguucuacucccuggcccccauggggaacggaaccggucgacgcagauga

SEQ ID NO: 20994 - RNA, 1617 nt, Artificial Sequence
  derived and/or modified sequence opt3 from VP1__Norovirus_and/or_Norovirus-like__AB933771
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuaccggcagccggaacuacacgaugaaucucgccucucagaacuggaacuccuaugaucccacugaggaaaucccugcaccacuggguacacccgacuucguugggaagauucagggagugcuuacccagacuacacgcaccaauggcucaacgcgaggccacaaggcuaccgucuacacagggagcgccgacuuuaguccuaagcugggaagagugcaauucgcuacugauaccgacaaugauuuugaggccaaccagaauacaaaauucacuccagucggugugauccaggacggcucuaccacacccaggaacgaaccgcaacaguggguuuugccuuccuacagcgggcggaauauccauaacgugcaccucgcaccagccguagcucccaccuuuccuggagagcagcuguuauucuuucguucgacuaugcccggcuguucugguuauccaaauauggaucuggacugccuccuuccucaggaauggguccaauacuucuaucaggaggcggcacccgcccaguccgauguggcucuguugcgcuuuguuaacccagacacggggagagugcuauucgaguguaagcugcacaaaucaggcuacgucacaguggcccauaccggacagcacgaucucguaauuccgccuaacggcuauuuuagguucgacaguugggugaaucaauucuacacucuggcacccauggggaacggaaccggucggcgacgcuga

SEQ ID NO: 20995 - RNA, 1617 nt, Artificial Sequence
  derived and/or modified sequence opt3 from VP1__Norovirus_and/or_Norovirus-like__LC005732
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugauagggacuuugaagcaaaucagaacaccaaauucacaccaguuggugugauccaggauggcgggacuacccaucggaaugagccccaacaguggguauugccgagcuacaguggacguaacacaccuaauguccaccucgccccagcuguggcgcccaccuuuccuggcgaacagcuguuauucuuucgcucuacuaugcccgguuguuccggguauccaaacauggaccuggauugccuccuuccucaggaguggguucaauacuucuaucaggaggcagcccccgcucagagcgacguggcccuguugagauuugucaauccagauacgggcagggugcuauucgaauguaagcugcacaaaucgggauacgcaacaguagcccauaccggccagcacgaccucgugauuccgccuaacggguauuuucgguucgauucuuggguuaaccaauucuacacucuggcucccaugggaaaugguaccggccgacgcagauga

SEQ ID NO: 20996 - RNA, 1617 nt, Artificial Sequence
  derived and/or modified sequence opt3 from VP1__Norovirus_and/or_Norovirus-like__KP293591
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggaaugcuuacacagaccacucgcgccgacggcuccacacgaggccacaaggcuaccguguacacggggucagccaauuuugcaccuaagcugggaagaguccaauucgagaccgauacagaccaugauuuugaagccaaccagaauacuaaauucaccccaguggguguuauccaggacggcagcacaacucacaggaacgagccccaacaguggguguugccgaguuacucugggcggaauaccccuaacguacaccucgcuccagcggucgcacccacauuuccuggagaacagcuguuauucuuucguuccaccaugcccggcuguagcgguuauccaaauauggaucuggacugccuccuuccucaggagugggugcaauacuucuaucaggaggccgcucccgcccagucggauguugcacuguugcgcuuugugaacccagacacugggagaguccuauucgaauguaagcugcauaaaucuggcuacgugacgguagcccacacaggacagcaugaucucgugauuccgccuaacggcuauuuuagguucgacuccuggguuaaucaauucuacacccuggcucccauggggaacggaacuggucggcgacgcuga

SEQ ID NO: 20997 - RNA, 1617 nt, Artificial Sequence
  derived and/or modified sequence opt3 from VP1__Norovirus_and/or_Norovirus-like__KP176396
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacaaucgaaucccggaccaaaccuuucucuguccccguguuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacuggaauaacuaugaucccacggaggaaauuccugcuccacuggguacucccgacuucguggggaagauccagggaguccuuacacagaccacucgcacagacggcuccacccgaggccacaaggccacgguguacaccgggucagcugauuuuagcccuaagcugggaagaguccaauucgagacagacacugaucaugacuuugaagccaaucagaacaccaaauucacaccaguggguguuauucaggauggcgggacuacccacaggaaugagccccaacaguggguguugccgaguuacucuggacggaacacaccuaauguacaccucgcaccagccgucgcucccaccuuuccuggcgaacagcuguuauucuuucguuccacuaugcccgguuguagcggguauccaaacauggaccuggauugccuccuuccucaggagugggugcaauacuucuaucaggaggcggcacccgcccagucggacguugcucuguugcgcuuugugaauccagauacgggcagaguccuauucgaauguaagcugcauaaaucuggauacgugacaguagcccacaccggccagcaugaccucgugaucccgccuaacggguauuuuagguucgauuccuggguuaaccaauucuacacucuggcacccaugggaaaugguaccggccggcgacgcuga

SEQ ID NO: 20998 - RNA, 1617 nt, Artificial Sequence
  derived and/or modified sequence opt3 from VP1__Norovirus_and/or_Norovirus-like__KP176394
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccgcugaggaaauaccugccccacuggguacgcccgacuucgucgggaagauucagggagugcuuacucagacaacccggacugacggcucaacacgcggccauaaggcuaccgucuacacggggagcgccgauuuugcaccuaagcugggacgagugcaauucgagaccgacacagauagagacuuugaagccaaccagaauacuaaauucaccccaguuggugugauccaggauggcgggacaacucacaggaacgagccccaacaguggguauugccgaguuacucuggacggaauaccccuaacguccaccucgcuccagcgguggcacccacauuuccuggcgaacagcuguuauucuuucguuccaccaugcccgguuguagcggguauccaaauauggaccuggauugccuccuuccucaggaguggguucaauacuucuaucaggaggccgcucccgcccagucggacguggcacuguugcgcuuugucaacccagauacuggcagagugcuauucgaauguaagcugcauaaaucuggauacguaacgguggcccacacaggccagcaugaccucguuauuccgccuaauggguauuuuagguucgauuccugggucaaccaauucuacacccuggcucccaugggaaacgguacuggccggcgacgcuga

SEQ ID NO: 20999 - RNA, 1617 nt, Artificial Sequence
  derived and/or modified sequence opt3 from VP1__Norovirus_and/or_Norovirus-like__KP096348
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacuaaccacgauuuugacgcaaaucagaacaccaaauucacaccaguuggugugauccaggauggcgggacuacccacagaaaugaaccccaacaguggguauugccgaguuacucuggaaggaacacaccuaauguccaucucgccccagcuguggcgcccaccuuuccuggcgagcagcuguuauucuuucgguccacuaugcccgguuguagcggguauccaaacauggaccuggauugccuccuuccucaggaauggguucaauacuucuaucaggaggcagcccccgcucagucggacguggcccuguugcguuuugucaauccagauacgggccgcgugcuauucgaguguaagcugcacaaaucuggauacguaacaguggcacauaccggccagcacgaccucguuauuccgccuaacggguauuuuagauucgauuccugggucaaccaauucuacacucuggcccccaugggaaaugguaccggcaggcggcgauga

SEQ ID NO: 21000 - RNA, 1617 nt, Artificial Sequence
  derived and/or modified sequence opt3 from VP1__Norovirus_and/or_Norovirus-like__KP096344
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccucauaugaucccacggaggaaauaccugcuccacuggguacucccgacuucgucgggaagauucagggaaugcuuacacagaccacucgcacagacggcagcacccgaggccacaaggccacgguguacaccgggagugcugauuuugccccuaagcugggaagaguccaauucgagacagacacugaucaugacuuugaagcaaaucagaacaccaaauucacaccaguggguguuauccaggauggcucuacuacccacaggaaugagccccaacaguggguguugccguccuacagcgggcggaacacaccuaauguacaccucgccccagcugucgcgcccaccuuuccuggagaacagcuguuauucuuucguucgacuaugcccggcuguucugguuauccaaacauggaccuggauugccuccuuccucaggagugggugcaauacuucuaucaggaggcagcccccgcucaguccgacguugcccuguugcgcuuugugaauccagauacggggagaguccuauucgaauguaagcugcauaaaucaggcuacgugacaguagcacacaccggacagcaugaccucgugauuccgccuaacggcuauuuuagguucgauaguuggguuaaucaauucuacacucuggcccccauggggaacggaaccggucggcgacgcuga

SEQ ID NO: 21001 - RNA, 1617 nt, Artificial Sequence
  derived and/or modified sequence opt3 from VP1__Norovirus_and/or_Norovirus-like__KM982946
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaaaccaaccagaauacaaaauucacuccaguuggugugauccaggauggcgggaccacacaucggaacgagccccaacaguggguauugccgaguuacucuggacguaauaccccuaacguccaccucgcaccagccguggcucccacuuuuccuggcgaacagcuguuauucuuucgcuccacgaugcccgguuguagcggguauccaaauauggaccuggauugccuccuuccucaggaguggguucaauacuucuaucaggaggcggcacccgcccagucggacguggcucuguugagauuugucaacccagauacaggcagggugcuauucgaauguaagcugcacaaaucuggauacguaaccguggcccauacuggccagcacgaccucguuauuccgccuaauggguauuuucgguucgauuccugggucaaccaauucuacacccuggcacccaugggaaacgguacaggccgacgcagauga

SEQ ID NO: 21002 - RNA, 1617 nt, Artificial Sequence
  derived and/or modified sequence opt3 from VP1__Norovirus_and/or_Norovirus-like__KM514070
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccaugucacaggcagccggaacuacaccaugaaucucgcaucucagaacugguccaauuaugaucccacggaggaaaucccugcuccacuggguacucccgacuucguggggaagauacagggaguccuuacacagaccacucgcacagacggcucaacccgaggccacaaggccacgguguacaccgggagcgcuaacuuugccccuaagcugggaagaguucaauucgagacagauacugaccaugauuuugaagcaaaucagaacaccaaauucacaccaguggguguaauucaggacggcgggacuacccacaggaaugagccccaacagugggucuugccgaguuacucuggacggaacacaccuaaugugcaccucgccccagcuguugcgcccaccuuuccuggcgaacagcuguuauucuuucguuccacuaugcccgguuguagcggguauccaaacauggaucuggacugccuccuuccucaggagugggugcaauacuucuaucaggaggcagcccccgcucagucggaugucgcccuguugcgcuuugugaauccagacacgggcagaguacuauucgaauguaagcugcauaaaucuggauacgugacaguugcacacaccggccagcaugaucucgucaucccgccuaacggguauuuuagguucgacuccugggugaaccaauucuacacucuggcccccaugggaaaugguaccggccggcgacgcuga

SEQ ID NO: 21003 - RNA, 1617 nt, Artificial Sequence
  derived and/or modified sequence opt3 from VP1__Norovirus_and/or_Norovirus-like__KM514061
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcagauuauccuagcaggaaacgccuuuacagcuggcaaagucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaugacccaaccaucaaguugauugcuaugcucuauacaccccugcgugccaacaacgcgggggaugacgucuucacuguuagcugcagagugcugaccaggccgaguccugauuuugacuucaucuuucucguacccccaacaguggaaucccggaccaaaccuuucucuguccccguguuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccacaacuacaccaugaaucucgcaucucagaacugguccaauuaugaucccacggaggaaauuccugcuccacuggguacucccgacuucguggggaagauccagggaguccuuacacagaccacucggacagacggcucaacccgcggccauaaggccacgguguacaccgggagcgcugauuuugccccuaagcugggacgaguccaauucgagacagacacugauagagacuuugaagcaaaccagaauaccaaauucacaccaguggguguuauucaggauggcgggacuacccacaggaacgagccccaacaguggguguugccgaguuacucuggacggaauacaccuaacguacaccucgccccagcugucgcgcccaccuuuccuggcgaacagcuguuauucuuucguuccacuaugcccgguuguagcggguauccaaauauggaccuggauugccuccuuccucaggagugggugcaauacuucuaucaggaggcagcccccgcucagucggacguugcccuguugcgcuuugugaacccagauacgggcagaguccuauucgaauguaagcugcauaaaucuggauacgugacaguagcacacaccggccagcaugaccucgugaucccgccuaauggguauuuuagguucgauuccuggguuaaccaauucuacacucuggcccccaugggaaacgguaccggccggcgacgcuga

SEQ ID NO: 21004 - RNA, 1617 nt, Artificial Sequence
  derived and/or modified sequence opt3 from VP1__Norovirus_and/or_Norovirus-like__KM514060
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuuagcccuaagcugggaagagugcaauucgagacagacacugaucaugacuuugaagccaaucagaacaccaaauucacaccaguuggugugauccaggauggcgggacuacccacaggaaugagccccaacaguggguauugccgaguuacucuggacggaacacaccuaauguccaccucgcaccagccguggcucccaccuuuccuggcgaacagcuguuauucuuucguuccacuaugcccgguuguagcggguauccaaacauggaccuggauugccuccuuccucaggaguggguucaauacuucuaucaggaggcggcacccgcccagucggacguggcucuguugcgcuuugucaauccagauacgggcagagugcuauucgaauguaagcugcauaaaucuggauacguaacaguggcccacaccggccagcaugaccucguuauuccgccuaacggguauuuuagguucgauuccugggucaaccaauucuacacucuggcacccaugggaaauggugccggccggcgacgcuga

SEQ ID NO: 21005 - RNA, 1617 nt, Artificial Sequence
  derived and/or modified sequence opt3 from VP1__Norovirus_and/or_Norovirus-like__KM268079
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaugacccaaccaucaaguugauugcuaugcucuauacaccccugcgugccaacaacgcgggggaugacgucuucacuguuagcugcagagugcugaccaggccgaguccugauuuugacuucaucuuucucguacccccaacaguggaaucccggaccaaaccuuucucuguccccguguuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacugguccaauuaugaucccacggaggaaauuccugcuccacuggguacucccgacuucguggggaagauccagggaguccuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauucaggauggcgggacuacccacaggaacgagccccaacaguggguguugccgaguuacucuggacggaauacaccuaacguacaccucgccccagcugucgcgcccaccuuuccuggcgaacagcuguuauucuuucguuccacuaugcccgguuguagcggguauccaaauauggaccuggauugccuccuuccucaggagugggugcaauacuucuaucaggaggcagcccccgcucagucggacguugcccuguugcgcuuugugaacccagauacgggcagaguccuauucgaauguaagcugcauaaaucuggauacgugacaguagcacacaccggccagcaugaccucgugaucccgccuaauggguauuuuagguucgauuccuggguuaaccaauucuacacucuggcccccaugggaaacgguaccggccggcgacgcuga

SEQ ID NO: 21006 - RNA, 1617 nt, Artificial Sequence
  derived and/or modified sequence opt3 from VP1__Norovirus_and/or_Norovirus-like__KJ710247
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccugucuuaacuaucgaggaaaugacaaacagccgcuuucccauaccacuggagaaacuuuucaccggacccuccucagccuucgugguucagccucagaaugguagauguacgacugauggcguguugcuggggaccacacaacuaaguccagucaacauuugcacuuuuaggggagacgugacccauaucacaggcagccggaauuacaccaugaaccucgcaucucagaauuggaacaauuaugauccgacggaggaaauucccgcuccucuggguacuccagacuucguagggaagauccagggaaugcuuacacagaccacucgcacagacggcuccacccgaggccacaaggccacgguuuacaccgggucagcugauuuugcccccaagcugggaagagugcaauucgagacagacacugaucaugacuuugaagcaaaccagaauaccaaauucacaccuaucggugucauucaggauggcagcacuacccacaggaacgagccacaacaguggguguugcccaguuacucugggcggaauacacacaacguccaucucgccccggcuguggcgccuaccuuuccaggagaacagcuguuauucuuucguuccacuaugcccggcuguagcgguuauccuaauauggaccuggauugccuccuuccccaggaguggguucaauacuucuaucaggaggcagccccagcucagucggacguggcccuguugcgcuuuguaaacccugauacggggagaguccuauucgaauguaagcugcacaaaucuggcuacgugacaguugcacauaccggacagcacgaccucgugauacccccaaacggcuauuuuagguucgauuccugggucaaucaauucuacacucuggccccgauggggaacggaaccggucggcgacgcuga

SEQ ID NO: 21007 - RNA, 1617 nt, Artificial Sequence
  derived and/or modified sequence opt3 from VP1__Norovirus_and/or_Norovirus-like__KJ685405
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcagacuauucuagcgggaaacgcauuuacggccggcaaaaucauuuucgcugccgucccuccaaauuuuccgaccgagggccucucucccucacaggugacaauguucccucauaucauaguagacguucgccaacuggagccagugcuuaucccccugccugauguccgaaacaauuuuuaucacuacaaccagacuaaugacccaaccauuaaguugaucgcaaugcucuauacaccccugcgugcuaacaacgccggggaugacguguucaccgugucgugcagaguccugacuaggccgagcccugauuuugacuucauuuuucucguucccccaacaguggaaagucggaccaaaccuuucuccguacccguguuaacggucgaggaaaugacuaauucucgcuuuccaaucccccuggagaaacuuuucaccggaccuagcuccgcguucgugguucagccacagaacgguagauguacaacugauggcguguugcuggggaccacacaacuaucaccggucaauauaugcaccuuuaggggagacgugacgcauauuaguggcagccggaacuacacuaugaaucucgccucucagaacuggaacuccuaugaucccacagaggaaaucccugcaccacuggguacccccgacuucguagggaagauucagggaguucuuacucagacaacccgcacggacggcucaacccgaggccacaaggcuacaguguacacugggagcgccgauuuuaguccuaagcugggaagaguccaauucgcuaccgacacagauaaugacuuugagacuaaucagaacaccaaauucacaccagugggugucauccaggauggcgggaccacucauaggaaugaaccccaacaguggguguugccgucuuacuccggacggaacacgcacaauguucaccucgccccugcaguggccccaacauuucccggcgagcagcuguuauucuuucguagcaccaugccugguuguucgggguaucccaacauggaccuggauugccuccuuccacaggaauggguacaauacuucuaucaggaggcugcgccugcacagucugacgucgcccuguugcgcuuugugaaucccgauacuggcagaguucuauucgaguguaagcugcauaaauccggauacgugaccgucgcucacacaggccagcaugaccucgugaucccaccgaacggguauuuuagguucgauucauggguaaaccaauucuacacccuggccccuaugggaaaugguacuggccggcgacgcuga

SEQ ID NO: 21008 - RNA, 1617 nt, Artificial Sequence
  derived and/or modified sequence opt3 from VP1__Norovirus_and/or_Norovirus-like__KF429766
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucaucaaucagaacaccaaauucacaccaguggguguuauccaggauggcuccacuacccccaggaaugagccgcaacaguggguguugccuagcuacucggggcggaacacacauaauguacaccucgccccagcagucgcccccaccuuuccuggagaacagcuguuauucuuucguucuacuaugcccggcuguuccgguuauccaaacauggaccuggauugccuccuuccucaggagugggugcaauacuucuaucaggaagcugcgcccgcacagucagacguugcccuguugcgcuuugugaauccagauacggggagaguccuauucgaguguaagcugcacaaaaguggcuacgugacaguagcucauaccggacagcacgaccucgugauuccgccuaacggcuauuuuagguucgauagcuggguuaaccaauucuacacucuggcccccauggggaauggaaccggucggcgacgcuga

SEQ ID NO: 21009 - RNA, 1617 nt, Artificial Sequence
  derived and/or modified sequence opt3 from VP1__Norovirus_and/or_Norovirus-like__KF060009
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaugcaaaucagaacaccaaauucacaccaguuggugugauccaggacggcgggacuacccacaggaaugaaccccaacaguggguauugccgagcuacaguggacggaacacacacaauguccaucucgccccugcuguggcgccaaccuuucccggcgagcagcuguuauucuuucguucuacuaugccugguuguuccggguaucccaacauggaucuggacugccuccuuccacaggaauggguucaauacuucuaucaggaggcagccccugcucagagcgauguggcccuguugcgcuuugucaaucccgacacgggcagagugcuauucgaguguaagcugcacaaaucgggauacguaacaguggcacauaccggccagcacgaucucguuauuccaccgaacggguauuuuagguucgacucuugggucaaccaauucuacacucuggccccuaugggaaaugguaccggccggcgacgcuga

SEQ ID NO: 21010 - RNA, 1617 nt, Artificial Sequence
  derived and/or modified sequence opt3 from VP1__Norovirus_and/or_Norovirus-like__KF059996
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacuaagacaaauggcucaacccgcggccacaaggcuacggucuacaccgggagcgccgacuuuaguccaaaacugggacgagugcaauucgcuacagauacugacaaugauuuugagaccaaccagaauacaaaguucacucccgucggugugauccaggacggcucuaccacaccgagaaacgaaccucaacaguggguuuugccauccuacagcgggaggaauauccauaacgugcaccucgcccccgcaguagccccuaccuuucccggagagcagcuguuauucuuucggucgacuaugccaggcuguucugguuauccuaauauggaucuggacugccuccuuccccaggaauggguccaauacuucuaucaggaggcugcgccagcacaguccgauguggcccuguugcguuuuguuaacccggacacggggcgcgugcuauucgaguguaaacugcacaagucaggcuacgucacaguggcucauaccggacagcacgaucucguaauuccucccaacggcuauuuuagauucgacaguugggugaaucaauucuacacucuggccccaauggggaacggaaccgguaggcggcgauga

SEQ ID NO: 21011 - RNA, 1617 nt, Artificial Sequence
  derived and/or modified sequence opt3 from VP1__Norovirus_and/or_Norovirus-like__HF952130
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacaguacaauuaaguugaucgcaaugcucuauacuccacugcgugcuaauaacgccggggaugacguguucaccgucuccugcagaguucugacaaggcccucuccggauuuugacuucauuuuucucgugccucccaccguagaaagccggacuaaaccauucuccgugccugucuuaacaguggaggaaaugaccaacucacgcuuucccaucccacuggagaaacuuuucacgggacccaguagcgcguucguugugcagccucagaaugguagauguacuaccgauggcgucuugcuggggacaacucaacuaucuccagugaacauaugcaccuuuaggggagacguaacacauauuuccggcucacggaauuacaccaugaaccucgccagccagaauuggaacaguuaugauccgacggaggaaauccccgcaccucuggguacuccagacuucguugggaagauucagggagugcuuacacagaccacuaagacaaauggcucuacccgcggccacaaggcuacggucuacaccggguccgccgacuuuagccccaaacugggacgagugcaauucgcuacagauacugacaacgauuuugagaccaaucagaacacaaaguucacuccugucggugugauccaggacggcucgaccacaccaagaaaugaaccccaacaguggguuuugccgucuuacuccgggaggaacacccauaaugugcaccucgccccugcaguagccccaacuuuucccggagagcagcuguuauucuuucggucaacgaugccuggcuguagugguuaucccaacauggaucuggacugccuccuuccacaggaauggguccaauacuucuaucaggaggcugcgccugcacagagcgauguggcccuguugcguuuuguuaaucccgacacagggcgcgugcuauucgaguguaaacugcacaaguccggcuacgucaccguggcucauacuggacagcacgaucucguaaucccaccgaacggcuauuuuagauucgacucuugggugaaccaauucuacacccuggccccuauggggaauggaacagguaggcggcgauga

SEQ ID NO: 21012 - RNA, 1617 nt, Artificial Sequence
  derived and/or modified sequence opt3 from VP1__Norovirus_and/or_Norovirus-like__KC409302
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaucaaccagaauaccaaauucacacccgucggugugauccaggacggcucuacuaccccgaggaacgaaccucaacaguggguuuugccauccuacagcgggcggaauauucauaacgugcaccucgcccccgcaguagccccuacauuucccggagagcagcuguuauucuuucguucgaccaugccaggcuguucugguuauccuaauauggaucuggacugccuccuuccccaggaauggguccaauacuucuaucaggaggcugcgccagcacaguccgauguggcccuguugcgcuuuguuaacccggacacugggagagugcuauucgaguguaagcugcacaaaucaggcuacgucacgguggcucauacaggacagcacgaucucguaauaccucccaacggcuauuuuagguucgacaguugggugaaucaauucuacacccuggccccaauggggaacggaacuggucggcgacgcuga

SEQ ID NO: 21013 - RNA, 1617 nt, Artificial Sequence
  derived and/or modified sequence opt3 from VP1__Norovirus_and/or_Norovirus-like__JX459908
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaaugauuaugaccccacggaggaaauaccugcuccacuggguacucccgacuucgucgggaagauucagggagugcuuacacagaccacucgcacagauggcuccacccgaggccacaaggccacggucuacaccgggucagcugacuuugccccuaagcugggaagagugcaauucgagacagauacugacagggauuuugaagcaaaccagaauaccaaauucacaccaguuggugugauccaggacggcgggacuacccaucggaacgagccccaacaguggguauugccgagcuacaguggacguaauacacacaacguccaccucgccccugcuguggcgccaaccuuucccggcgaacagcuguuauucuuucgcucuacuaugccugguuguuccggguaucccaauauggaucuggacugccuccuuccacaggaguggguucaauacuucuaucaggaggcagccccugcucagagcgauguggcccuguugagauuugucaaccccgacacgggcagggugcuauucgaauguaagcugcauaaaucgggauacguaacaguggcacacaccggccagcaugaucucguuauuccaccgaauggguauuuucgguucgacucuugggucaaccaauucuacacucuggccccuaugggaaacgguaccggccgacgcagauga

SEQ ID NO: 21014 - RNA, 1617 nt, Artificial Sequence
  derived and/or modified sequence opt3 from VP1__Norovirus_and/or_Norovirus-like__JX445166
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccacaacuacaccaugaaucucgccucucagaacuggaacuccuaugauccuacggaggaaaucccagcaccccuggguacuccugacuucguugggaagauucagggagugcuuacacagaccacucggacaaauggcucaacccgcggccauaaggcuacggucuacaccgggagcgccgacuuuaguccaaagcugggacgagugcaauucgcuacagauacuaauaacgacuuugagaccaaucagaacacaaaauucacucccgucggugugauccaggauggcucuaccacaccgagaaaugaaccucaacaguggguuuugccauccuacagcgggaggaacacccacaaugugcaccucgcccccgcaguagccccuacuuuucccggagagcagcuguuauucuuucggucgacgaugccaggcuguucugguuauccuaacauggaccuggauugccuccuuccccaggaauggguccaauacuucuaucaggaggcugcgccagcacaguccgacguggcccuguugcguuuuguuaacccggauacagggcgcgugcuauucgaguguaagcugcauaaaucaggcuacgucaccguggcucacacuggacagcaugaccucguaaucccucccaauggcuauuuuagauucgauaguugggugaaccaauucuacacccuggccccaauggggaauggaacagguaggcggcgauga

SEQ ID NO: 21015 - RNA, 1617 nt, Artificial Sequence
  derived and/or modified sequence opt3 from VP1__Norovirus_and/or_Norovirus-like__HQ693090
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuugccguuucaccaaggaacgcucccggggagauccuuuggagugccccucugggaccagauuugaaucccuacuuaagccaccuggcgcggauguauaacggcuacgccgguggguucgaagugcaggucauucuagcaggaaaugcuuuuaccgccggcaaaaucauuuucgcagcugugccuccaaacuuuccgacagagggccucucccccucucagguaacuauguucccucauaucauaguugacgugcgccaacuggagccaguccuuaucccccugccugaugugcgaaauaacuuuuaucacuacaaucagucgaacgacucaacgauuaaguugaucgccaugcucuauaccccacugcgugcgaacaaugccggggaagauguguucacagucagcugcagaguucugacuaggcccaguccggacuuugauuucauuuuucucgugccucccaccguagagucccggacaaaaccauucaccgugccuaucuuaacugucgaagagaugacaaacucucgcuuucccauaccacuggagaaacuuuucaccggacccagcggugcauucgugguucagccucagaauggcagauguacgacugacgggguguugcugggaaccacacaacuauccccagucaacauuugcacuuuuaggggcgaugugacccauaucgcugguucacggaauuacacaaugaaccucgccagucugaauuggaacaauuaugacccgaccgaagagauucccgcuccucuugggacgccagauuucguaggaaagauccagggcguucugacucagacaaccaagggcgacgggagcacucgcggacacaaggccacaguguacaccgguucugcacccuuuacgccuaaauugggcuccguccaguucucaaccgacacagaaaacgauuuugagacucaucaaaauaccaaguucgccccagugggggucauccaggacggaagcacaacucaccgaaacgaaccccagcaaugggugcucccgaguuacucuggcgguaauguucacaacgugcaucuggcuccugcgguagcaccaaccuuucccggggagcaguuacuguucuuuagauccacaaugccuggcuguagcggauaucccaauauggaucucgacugccuucugccacaggaguggguccagcacuucuaccaagaagccgcuccugcccagucggauguggcauugcuaagguuuguuaaccccgacaccggccgggugcuguucgaguguaaacuccauaagucuggguaugucacuguggcccacacgggacagcacgaucugguaauuccaccgaacgguuacuuucguuucgacuccugggugaaucaguucuauacacuugcuccuaugggcaacgggaccggacgcagaagguga

SEQ ID NO: 21016 - RNA, 1617 nt, Artificial Sequence
  derived and/or modified sequence opt3 from VP1__Norovirus_and/or_Norovirus-like__JN400611
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugaucucauuuucuuagugccucccacaguagagucccggaccaaaccauuuacugugccuauccugacagucgaagagaugaccaacucucgcuuccccauaccacuugagaaguuguuuacgggacccagcggugccuucgugguucagccucagaauggcagauguacuaccgacggggugcugcuaggaacaacucaacucuccccagucaacauuugcaccuucaggggcgaugugacacauaucgcagguucacggaauuacaccaugaaccuggcuagucuuaauuggaacaauuaugacccgacggaagagauucccgccccucuggggacuccagauuuuguaggaaaaauccagggcguuuugacacagaccacuaagggcgacgggagcacacgcggacacaaggcuaccguguacacggguggcgcccccuucaccccuaaacucgggucuguccaguuuuccacagacacugaaaacgauuucgagacccaucaaaauacaaaguuuacuccagugggagucauccaggacggcucaaccacacaccgaaacgaaccccagcaaugggugcugccgagcuacagugguagaaauguucacaacgugcauuuagccccugcaguagcuccaaccuuccccggggagcagcugcucuuuuucaggucuacuaugccuggcuguuccggauaucccaauauggaucuugacugccuguugccacaggaguggguccagcacuuuuaccaagaagcggccccugcacagagcgauguggcucuacugcgguucguuaaccccgacacgggccgugugcucuuugaguguaaacugcauaagucgggguaugucacaguggcccacaccggacagcacgaucuuguaauuccaccgaacgguuacuuccgcuuugacucuugggugaaucaguucuauacucuggcaccuaugggcaacgggaccggaagaaggcgguga

SEQ ID NO: 21017 - RNA, 1617 nt, Artificial Sequence
  derived and/or modified sequence opt3 from VP1__Norovirus_and/or_Norovirus-like__JN400609
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucgggcccucccagguaacgauguucccucauaucauaguugacgugcgccaacuggagccaguccuuaucccccugccugaugugcgaaauaacuuuuaucacuacaaucagucuaacgacucgaccauuaaguugaucgcuaugcucuauacaccacugcgugccaacaaugcgggagaagauguguucacugucucaugcagaguucugaccaggcccagcccggacuuugauuucauuuuucucgugccucccacaguagagagucggaccaaaccauucacugugccuaucuuaacagucgaagagaugaccaacucccgcuuucccauaccacuggagaaacuuuucacgggucccucuggcgccuucgugguucagccucagaaugggagauguacuaccgacggaguguugcugggcacaacucaacuaagcccagucaacauuugcaccuuuaggggugaugugacacauaucgcagggucccggaauuacaccaugaaccucgcuucacugaauuggaacaauuaugacccgacggaagagauucccgccccucuuggaacuccagauuucguaggcaagauccagggcguucugacacagaccacuaagggggacggaaguacacgcggucacaaggcuaccguguacacgggcggggcccccuuuaccccuaaauugggaagcguccaguucucuacagacacugaaaacgauuuugagacccaucaaaauacaaaguucacuccagugggcgucauccaggacgguuccaccacacaccgaaacgaaccccagcaaugggugcucccgucauacagcgggagaaauguucacaacgugcaucuggccccugcaguagcuccaaccuuucccggcgagcaguuacuguucuuuaggaguacuaugccuggauguucuggcuaucccaauauggaucucgacugccuucugccacaggaguggguccagcacuucuaccaagaagcggccccugcacaguccgauguggcuuugcuacgguuuguuaaccccgacacggggcgugugcuguucgaguguaaacuccauaagagcggauaugucacaguggcccacaccggucagcacgaucugguaauuccaccgaacggcuacuuucgcuucgacucgugggugaaucaguucuauacucuugcaccuauggggaacggaaccggcagaaggcgguga

SEQ ID NO: 21018 - RNA, 1617 nt, Artificial Sequence
  derived and/or modified sequence opt3 from VP1__Norovirus_and/or_Norovirus-like__JQ613517
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggauccaguccuuaucccccugccugacgugcgaaacaauuuuuaucacuacaaccagagcaaugauccaacaauuaaguugaucgcaaugcucuauacuccccugcgugcuaacaacgccggcgacgauguguucaccgucaguugcagaguucugacaaggccguccccugacuuugauuucauuuuucucgugcccccaaccguagagucucggacuaaaccuuucagcgugcccaucuuaacagucgaagagaugaccaauucccgcuuuccaauaccccuggaaaaacuuuucacggggccuucaagugcguucgugguucagccacagaacggaagauguacuaccgacgguguguugcugggcacaacucaacuaagcccggucaauauuugcaccuuuaggggagaugugacacauaucgccgggacccaggaguacacgaugaaccucgcaucucagaauuggaacaauuaugaccccacugaggaaauuccugcuccacugggcacacccgacuucguagguaagauccaggggguucuuacccaaacuacacggggagauggcuccacccgcggccacaaggccacggugucaaccgggagcguccauuuuacaccuaagcugggacgaauccaguucaguacugacaccucuaacgauuuugagacaggucagaauacuagauucaccccagugggcgucgugcaagacggguccacaacccaccagaacgaaccccagcaguggguuuugccgaauuacagcggaagggauucgcacaacgugcaucucgcuccugccguagcaccaucuuuucccggcgagcaacuguuauucuuucgguccacuaugccugguuguucaggguaccccaauaugaaccuggacugccuccuuccacaggaauggguccagcacuucuaucaggaggccgcuccugcgcaaagugauguggcacuguugcguuuuguuaaucccgacacgggccgcgugcuauucgaguguaaacugcauaagagcggauacgucacaguggcccacaccggccagcacgaucucguaauuccaccgaacggguauuuuagauucgacuccugggugaaccaguucuacacucuggcuccuaugggaaaugguaccggcaggcggcgauga

SEQ ID NO: 21019 - RNA, 1617 nt, Artificial Sequence
  derived and/or modified sequence opt3 from VP1__Norovirus_and/or_Norovirus-like__JQ478409
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuaugucacaguggcccacaccgggcagcacgaucugguaauuccaccgaacggauacuuucgcuucgacuccugggugaaucaguucuauacucuugcaccuauggguaacggcaccgggggaagaagguga

SEQ ID NO: 21020 - RNA, 1617 nt, Artificial Sequence
  derived and/or modified sequence opt3 from VP1__Norovirus_and/or_Norovirus-like__GQ856460
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacggaccccagcuccgccuucgugguucagccucagaauggaagauguacuaccgaugguguguugcugggcacaacucaacuaucaccagucaacauuugcaccuuuaggggagacgugacacauaucgcagggagucggaauuacaccaugaaccucgcuagccugaauuggaacaauuaugauccgacggaagagauucccgccccucuuggcacuccagacuucguagguaagauccaggggguucugacacagaccacuaagggagacggcucuacacgcggccacaaggcuaccguguacacgggguccgcccccuuuaccccuaaauugggaucaguccaguucagcacagauacugaaaacgacuuugagacccaucaaaauacaaaguucacuccagugggugucauccaggauggcgggaccacacaccgaaacgaaccccagcaaugggugcucccgaguuacucuggaagaaauguuccuaacgugcaccuggcaccagccguagcucccaccuuuccuggcgagcaguuacuguucuuuagguccacuaugcccgguuguagcggguauccaaauauggaccucgauugcccucuuccccaggaguggguccagcauuucuaccaagaagcggcaccagcccagucggacguggcucuguugcgguuuguuaacccggauacgggccgugugcuauucgaguguaaacugcacaagucuggauaugucacaguggcccauaccggccagcacgaccucguaauuccucccaacggguacuuucgcuucgauuccugggugaaucaguucuauacucuggcaccaaugggaaacgguaccggcagaaggcgguga

SEQ ID NO: 21021 - RNA, 1617 nt, Artificial Sequence
  derived and/or modified sequence opt3 from VP1__Norovirus_and/or_Norovirus-like__GQ856449
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcacccacaauuacacgaugaaccucgcuagucugaauuggaacaauuaugacccgacugaagagauucccgccccucuugguacaccagauuucguagggaagauccagggaguucugacccagacuacaaagggcgacggcagcacccgggggcauaaggcuacgguguacaccggaucugcccccuuuacaccuaaauuggguuccguccaguucucaacugacaccgaaaacgauuuugagacacaccaaaauacuaaguucaccccagugggcgucauccaggacgggagcacaacccaccgcaacgaaccccagcaaugggugcucccgaguuacucuggaggcaauguucagaacgugcaucuggccccugcaguagcuccaacuuuucccggugagcaguuacuguucuuucgauccacgaugccuggguguagcggcuaucccaauauggaucucgacugccuucugccacaggaguggguccaacacuucuaccaggaagcggccccugcacagucggauguggcuuugcuaagauuuguuaaccccgacacaggaagggugcuguucgaguguaaacuccauaagucuggcuaugucaccguggcccacacugggcagcacgaucugguaauuccaccgaacggauacucccgguuugacccuugggugaaucaauucuauacccuugcacccauggguaacggcacagggcgucgcagauga

SEQ ID NO: 21022 - RNA, 1617 nt, Artificial Sequence
  derived and/or modified sequence opt3 from VP1__Norovirus_and/or_Norovirus-like__EU921344
augaagauggccagcuccgacgcuacccccucugauggcucaacagcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacuguuaguccaaggaacgcacccggggagauccuuuggagcgccccucugggaccagauuugaaucccuacuuaucccaccuggcucggauguauaacggcuacgccgguggguucgaagugcaggucauucuagcgggaaaugcauuuacggccggcaaaaucauuuucgcugccgugccuccaaacuuuccgaccgagggccucucucccucgcagguaacaauguucccucauaucauaguugacgugcgccaacuggagccaguccuuaucccccugccugaugugcgaaauaacuuuuaucacuacaaucagucaaacgacccaacuauuaaguugaucgcaaugcucuauacaccccugcgugcuaauaacgccggggaugacguguucaccgucagcugcagaguucugaccaggccgaguccugauuuugacuucauuuuucucgugcccccaacuguagaaucccggacaaaaccuuucucugugcccaucuuaaccgucgaggaaaugacgaacagccgcuuuccaauaccccuggagaaacuuuucacuggaccuuccucagcguucgugguucagccacagaaugguagauguaccacagauggcguguugcuggggacuacccaacuaaguccggucaacauuugcacauuuaggggagacgugacccauaucgccggcacgcagaauuacacuaugaaccucgcaagccagaauuggaacaauuaugaucccacagaggaaauuccugcuccacuggguacccccgacuucguagggaagauccagggaaugccuacucaaacaacccggggcgacggcucuacgcgcgggcacaaggccaccguuuccacaggaucagugcauuuuacuccaaaacuugguagcguccaguucaguaccgauacaucuaacgacuuugagacuggccagaauacccgauucacacccgugggggucgugcaagauggauccaccacucaccagaacgaaccgcagcaguggguucugccuaauuacagcggcagagacucgcacaacgugcauuuggcuccagccguagcacccacguuuccuggugagcaacuccuguucuuuaggucuacaaugcccggguguuccggcuacccaaauaugaacuuagauugccugcucccucaggaauggguccagcacuucuaucaggagucagcccccgcucaaagugacguggcgcuucugcgguuuguuaauccagauaccggacguguguuguucgaguguaagcuacauaagagcggcuacgucacuguggcacacaccgggcagcacgaccugguaaucccgccuaacggauauuuucgcuucgauuccugggugaaccaguucuacacacucgcccccauggguaauggcgcugggagaaggcgguga

SEQ ID NO: 21023 - RNA, 1617 nt, Artificial Sequence
  derived and/or modified sequence opt3 from VP1__Norovirus_and/or_Norovirus-like__AB541290
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucgugcuagcaggaaaugccuuuacagcuggcaaaauuaucuucgccgcaguaccuccaaacuuuccgacugagggccucucccccucucagguuacgauguucccucauauuaucguggacguccgccaacuggagccagugcuuauaccccugccugaugugcgaaauaacuuuuaucacuacaaucagucgaacgacucaaccaucaaguugauugcuaugcucuauacaccacugcgugccaacaaugcgggggaagaugucuucacuguuagcugcagagugcugaccaggcccaguccggacuuugauuucaucuuucucguaccucccacaguggagucccggaccaaaccauucacugucccuauuuuaacaguggaagagaugaccaacucucgcuuucccaucccacuggagaaacuuuucacgggacccagcggugccuucguugugcagccucagaauggcagauguacuaccgacggggucuugcugggaacaacucaacuauccccagugaacauaugcaccuuuaggggcgauguaacacauauugcagguucacggaauuacaccaugaaccucgcuagucugaauuggaacaauuaugacccgacggaagagauccccgccccucuugggacuccagauuucguuggaaagauucagggcgugcugacacagaccacuaagggcgacgggagcacacgcggacacaaggcuaccgucuacacggguucuacccccuuuacaccuaaauugggcuccgugcaguucucaacugacaccgaaaacgauuuugagaaucaucaaaacacaaaguucacuccagucggggugauccaggacggaggcaccacacaccgaaaugaaccccagcaauggguucucccgagcuacagugguagaaacgugcagaauguacaccuggccccugcagucgccccaaccuuucccggggagcaguuacuguucuuuaggucuacuaugccuggcuguuccggauaucccaacauggaucucgacugccuucugccacaggagugggugcaacauuucuaccaggaagcugcgccugcacagagcgauguugccuugcuacgguuugugaaccccgacacgggccguguccuguucgaguguaaacuccacaagucgggguaugugacaguagcucauaccggacagcacgaucuggugaucccaccgaaugguuacuuucgcuucgacucuuggguuaaccaauucuauacucuugccccuaugggcaaugggaccggaagaaggcgguga

SEQ ID NO: 21024 - RNA, 1617 nt, Artificial Sequence
  derived and/or modified sequence opt3 from VP1__Norovirus_and/or_Norovirus-like__GQ845322
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccacccccuuuacaccuaaauugggcucaguccaguucagcacugacaccgaaaaugauuuugagacacaucaaaacacuaaguucaccccagugggggucauccaggacggaaguacaacccaccgaaaugaaccccagcaaugggugcucccgucuuacuccggcagagauguucacaacgugcaucuggccccugcaguagccccaacuuuucccggugagcaguuacuguucuuuaggagcacgaugccuggguguucgggcuaucccaauauggaccucgauugccuucugccacaggaguggguccagcacuucuaccaagaagcugcgccugcacagucugacguggccuugcuacgguuuguuaaccccgauacaggacgugugcuguucgaguguaaacuccauaaguccggcuaugucaccguggcucacacugggcagcacgaccugguaauuccaccgaauggauacuuucgcuucgauucaugggugaaccaguucuauacccuugccccuauggguaacggcacagggagaaggcgguga

SEQ ID NO: 21025 - RNA, 1617 nt, Artificial Sequence
  derived and/or modified sequence opt3 from VP1__Norovirus_and/or_Norovirus-like__AB220921
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaacaaauuucgugcaggcuccugguggcgaauuuacuguuaguccaaggaacgcacccggggagauccuuuggagcgccccucugggaccagauuugaaucccuacuuaucccaccuggcucggauguauaacggcuacgccgguggguucgaagugcaggucauucuagcgggaaaugcauuuacggccggcaaaaucauuuucgcugccgugccuccaaacuuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaacgccggggaugacguguucacagucaguugcagaguucugaccaggcccuccccggauuuugacuucauuuuucucgugccucccacuguagaaucucggacaaaaccauucaccgugccuaucuuaacggucgaggaaaugacuaacagccgcuuucccauaccacuggagaaacuuuucaccggacccuccucagcguucgugguucagccucagaaugguagauguacaacugauggcguguugcuggggaccacacaacuaaguccagucaacauuugcaccuuuaggggagacgugauccauauuccgggcacgcggacuuaccgcaugaaucucgccagccagaacuggaauaacuaugaucccacagaggaaaucccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgccaccgacacagauaaugacuuugagacuggccagaacaccagauucacaccagugggggucauucaggauggaaguucugcucauaggaaugaaccccaacaguggguguugccggacuacuccggccggaccguucacaacgugcaccucgccccugcaguagccccaacuuuucccggugagcagcuguuauucuuucguagcacgaugccuggguguucgggcuaccccaauauggaucuggacugccuccuuccacaggaauggguccaacauuucuaucaggaggcugcgccuucucaguccgauguggcacuguugcgcuuuguuaaccccgacacaggaagagugcuauucgaguguaagcugcacaaagccggcuacgucaccguggcucauacugggcagcacgaucucguaauaccaccgaauggauauuuuagguucgacucaugggugaaccaauucuacacccuggccccuauggguaauggcgcagggcggcgacgcuga

SEQ ID NO: 21026 - RNA, 1617 nt, Artificial Sequence
  derived and/or modified sequence opt3 from VP1__Norovirus_and/or_Norovirus-like__KX514221
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaucccggggaugacguguucacugucagcugcagaguucugaccaggccgaguccugauuuugacuucauuuuucucgugcccccaacaguagaaucccggaccaaaccuuucucugugcccaucuuaacugucggagagaugacaaacagccgcuuuccagugaaucuggaaagacuuuucaccggucccuccucagcgaacguugugcagccucagaaugggagguguacgauagauggcgaguugcugggaacuacccaacuaaguagcgucaacauuugcacauuccggggcgacgugacucauaucgguucuacccaccauuggacaaugaaucucgccuccccaaacuggaauaacuacgauccgaccgaggaaauucccgcaccucuggggacgccagacuuuguaggaaagauccagggcaugcuuacucagacaaccaaaggcgaggggucaacucgcggacaccgagcuacaguuuauguggguagcgccaauuacgcucccaagcugggcagaguccaguucgaaaccgacacgaccaacgauuuggacgcccaccaaaauacaaaguuuacuccugugggggucgugcagggaggcgagaguccacagaggucugaaccccaacaguggguucucccguccuacagcggucgggauaccccuaacgugcaucuggcaccagccguagcucccacauucccuggggagcaguuacuguuuuuccguucgacuauccccggcuguggaggccacccaaauaugaaccucgacugccuucugccucaggaguggguccaacauuuuuaucaggaagcggcacccgcccagucugauguggcuuugcuacgcuucguuaacccagacaccuccagagugcuguuugaguguaaacuccacaagucaggguacgucacaguggcccacaccggacagcaugaucugguaauuccgccuaaugguuauuucagguuugacaguugggugaaccaauucuacacucuugcacccaugggcaaugggacgggacggaaacgauga

SEQ ID NO: 21027 - RNA, 1617 nt, Artificial Sequence
  derived and/or modified sequence opt3 from VP1__Norovirus_and/or_Norovirus-like__KY486271
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggaaugcuuacacagaccacucgcgccgacggcuccacacgaggccacaaggcuaccguguacacggggucagccgauuuugcaccuaagcugggaagaguccaauucgagaccgacacagaucaugacuuugaagccaaucagaacacuaaauucaccccaguggguguuauccaggauggcagcacaacucacaggaaugagccccaacaguggguguugccgaguuacucugggcggaacacccacaauguacaucucgcuccugcggucgcaccaacauuucccggagaacagcuguuauucuuucguuccaccaugccuggcuguagcgguuaucccaacauggaccuggauugccuccuuccacaggagugggugcaauacuucuaucaggaggccgcuccugcccagucggacguugcacuguugcgcuuugugaaucccgauacugggagaguccuauucgaauguaagcugcacaaaucuggcuacgugacgguagcccauacaggacagcacgaccucgugauuccaccgaacggcuauuuuagguucgauuccuggguuaaccaauucuacacccuggcuccuauggggaauggaacuggucggcgacgcuga

SEQ ID NO: 21028 - RNA, 1617 nt, Artificial Sequence
  derived and/or modified sequence opt3 from VP1__Norovirus_and/or_Norovirus-like__KP784692
augaagauggccagcuccgacgcuaaccccucugauggcucaaccgcaaaucuggugccugaggucaacaaugaaguuauggcccucgagccagugguaggggcggcucuugccgcaccgguggccggacagcaaaacgucaucgaccccuggauuagaaguaauuucgugcaggcuccugguggcgaauuuacaguuagcccaaggaacgcacccggggagauacugugguccgccccuuugggaccagauuuaaaucccuaccugucucaccuagcucggauguauaacggcuacgccgguggguucgaagugcaggucauccucgcgggaaaugcauuuacugccggcaaagugauuuucgcugccguaccuccaaacuuuccgacggagggccugucgcccucacagguuaccauguucccucauaucauuguggacguccgccaacuugagccagugcugauccccuugccugaugugcgaaauaacuuuuaucacuacaaucagagcaacgaaaguacaauaaagcucaucgcaaugcuguauacuccacugcgugcuaauaacgccggggacgaugucuucaccguuuccugcagagugcucacaaggcccucuccggacuuugauuucaucuuuuuaguaccucccaccguggagagccggacuaaaccauucuccgucccuauucugacaguggaagagaugaccaacucacgcuuucccauuccacuugagagauuguucacgggacccaguagcgcguucguugugcagccucagaaugguagguguacuaccgacggcguccugcuagggacaacucaacucucuccagugaacaucugcaccuuucggggagauguaacacauaccacgggcucccacaauuacacuaugaaccuggccucacagaauuggagcaacuaugacccgacagaagagauacccgcaccucuugguaccccagauuucguugggaagauucagggagugcugacucagacaacccgcgcugacggcaguacgcgaggccauaaagccaccgucuacacagggucugcugacuuuacucccaaguugggaagagugcaauucgccaccgauacagaccacgauuuugacacuaaucagaacaccaaguucacaccugucggugugauccaggauggcuccaccacucacaggaaugaaccacaacaguggguucuccccagcuacucggggcggaacacgcauaaugugcaccuggcaccggccguagcuccuacauuuccaggagagcaguuacuguucuuucguucuaccaugcccggcuguuccgguuauccuaacauggaccucgauugccuucugccccaggaaugggucgcgcauuucuaccaagaggcagccccagcucagucagacguggccuugcuacgcuuuguuaauccugauacugggagagugcuguucgaguguaaacuccacaagaguggcuaugucaccguggcacacacaggacagcaugaccugguaauucccccaaacggcuacuuuagguucgauagcugggugaaucaguucuauacccuugccccgauggggaacggaacuggucggcgacgcuga

SEQ ID NO: 21029 - RNA, 1617 nt, Artificial Sequence
  derived and/or modified sequence opt3 from VP1__Norovirus_and/or_Norovirus-like__KX371604
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucguguucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccguguuaacaguugaggaaaugaccaauagccgcuuuccaauuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauaagcggcucucggaacuacaccaugaaucucgccucccagaacuggaacucauaugaucccacggaggaaauuccugcaccacuggguacucccgacuucguggggaagauccagggaguccuuacacagaccacucgcacaaauggcagcacccgaggccacaaggcuacgguguacaccgggagugccgacuuuucuccuaagcugggaagaguccaauucgcuacagauacugacaaugauuuugagaccaaccagaauacaaaauucacuccaguggguguuauucaggacggcuccaccacacccaggaacgaaccgcaacaguggguguugccuagcuacucggggcggaauauccauaacguacaccucgccccagcaaucgcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaauuccgccuaacggcuauuuuagguucgacagcugggugaaucaauucuacacucuggcccccauggggaacggaaccggucggcgacgcuga

SEQ ID NO: 21030 - RNA, 1617 nt, Artificial Sequence
  derived and/or modified sequence opt3 from VP1__Norovirus_and/or_Norovirus-like__KX354079
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaguuccugcaccacuggguacucccgacuucguggggaagauccagggaguccuuacacagaccacucgcacagacggcagcacccgaggccacaaggcuacgguguacaccgggagugccgauuuuucuccuaagcugggaagaguccaauucgcuacagacacugauaaugacuuuguggccaaucagaacaccaaauucacaccaguuggugugauucaggauggcuccacuacccccaggaaugagccgcaacaguggguauugccuagcuacucggggcggaacacacauaauguccaccucgcaccagccguggcucccaccuuuccuggagaacagcuguuauucuuucguucuacuaugcccggcuguuccgguuauccaaacauggaccuggauugccuccuuccucaggaguggguucaauacuucuaucaggaagcggcacccgcccagucagacguggcucuguugcgcuuugucaauccagauacggggagagugcuauucgaguguaagcugcacaaaaguggcuacguaacaguggcccauaccggacagcacgaccucguuaucccgccuaacggcuauuuuagguucgauagcugggucaaccaauucuacacucuggcacccaugggguccggaaccggucggcgacgcuga

SEQ ID NO: 21031 - RNA, 1617 nt, Artificial Sequence
  derived and/or modified sequence opt3 from VP1__Norovirus_and/or_Norovirus-like__KX354028
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaacuccugcuccacuggguacacccgacuucgucgggaagauacagggagugcuuacccagacuacacgcaccgacggcuccacgcgaggccacaaggccaccgucuacacagggucagcugauuuugccccuaagcugggaagagugcaauucgagacugacaccgaucaugacuuugaagcaaaucagaacacaaaauucacuccaguuggugugauucaggauggcagcaccacacacaggaaugagccccaacaguggguauugccgaguuacucugggcggaacacccacaauguccaucucgccccugcuguggcgccaacuuuucccggagaacagcuguuauucuuucguuccacgaugccuggcuguagcgguuaucccaacauggaccuggauugccuccuuccacaggaguggguucaauacuucuaucaggaggcagccccugcucagucggacguggcccuguugcgcuuugucaaucccgauacagggagagugcuauucgaauguaagcugcacaaaucuggcuacguaaccguggcacauacuggacagcacgaccucguuaucccaccgaacggcuauuuuagguucgauuccugggucaaccaauucuacacccuggccccuauggggaauggaacaggucggcgacgcuga

SEQ ID NO: 21032 - RNA, 1617 nt, Artificial Sequence
  derived and/or modified sequence opt3 from VP1__Norovirus_and/or_Norovirus-like__KX353983
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucguguucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccguguuaacaguugaggaaaugaccaauagccgcuuuccaauuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauaagcggcucucggaacuacaccaugaaucucgccucccagaacuggaacucauaugaucccacggaggaaauuccugcaccacuggguacucccgacuucguggggaagauccagggaguccuuacacagaccacucgcacagacggcagcacccgaggccacaaggcuacgguguacaccgggagugccgauuuuucuccuaagcugggaagaguccaauucgcuacagacacugauaaugacuuugugaccaaucagaacacaaaauucacuccaguuggugugauucaggauggcuccaccacacccaggaaugagccgcaacaguggguauugccuagcuacucggggcggaacacccauaauguccaccucgccccagcaguggcccccacuuuuccuggagaacagcuguuauucuuucguucuacgaugcccggcuguuccgguuauccaaacauggaccuggauugccuccuuccucaggaguggguucaauacuucuaucaggaagcugcgcccgcacagucagacguggcccuguugcgcuuugucaauccagauacagggagagugcuauucgaguguaagcugcacaaaaguggcuacguaaccguggcucauacuggacagcacgaccucguuaucccgccuaacggcuauuuuagguucgauagcugggucaaccaauucuacacccuggcccccauggggaauggaacaggucggcgacgcuga

SEQ ID NO: 21033 - RNA, 1617 nt, Artificial Sequence
  derived and/or modified sequence opt3 from VP1__Norovirus_and/or_Norovirus-like__AB972511
augaagauggccagcaacgacgcuaaucccuccgauggcccugcagccaaccuggugccagaggucaauaacgaaguuauggcgcucgagccggugguaggggcugccaucgcagcccccguggcuggacagcaaaaugucauugacccuuggauaagaaacaauuucgugcaggcaccagguggcgaauuuaccguuucucccaggaacgccccuggggagauccuuuggucagcuccacugggacccgauuugaauccuuacuuaagucaccuggcccggauguauaacggcuacgcggguggguucgaagugcaggucauucuagcaggaaaugccuuuacagcuggcaaaaucauuuucgccgcagugccaccgaacuuucccacugagggccucagcccuucccagguaacgauguucccacauaucauaguugacgugcgccaacuggagcccguccuuaucccucugccagaugugcgaaauaacuuuuaucacuacaaucagucuaacgacucgaccauuaaguugaucgcuaugcucuauacaccccugcgugccaacaaugcgggggaagauguguucacugucucaugcagaguucugaccaggccgagcccugacuuugauuucauuuuucucgugcccccaacaguagagagucggaccaaaccuuucacugugcccaucuuaacagucgaagagaugaccaacucccgcuuuccaauaccccuggagaaacuuuucacgggaccuucuagcgccuucgugguucagccacagaaugguagauguacuaccgacggcguguugcuggggacaacucaacuauccccggucaacauuugcaccuuuaggggagaugugacacauaucgcaggcucacggaauuacaccaugaaccucgcuagucugaauuggaacaauuaugaccccacggaagagauuccugccccacuugguacucccgauuucguagggaagauccagggaaugcugacacagaccacuaagggcgacggcagcacacgcgggcacaaggcuaccguuuacacgggaucugccccuuuuaccccaaaauuggguuccgugcaguucgaaacagacacugagaacgauuuugaaacccaucaaaauacaaaguucacucccgucggcgugauccaggacgggggaaccacacaccgaaacgagccgcagcaauggguccucccuucauacagcggcagaaaugugccaaacguucaccuggcacccgccguggcuccuaccuuucccggugagcaguuacuguucuuuaggaguauuaugccaggguguucuggcuauccuaauauggaucucgacugccuucugccccaggaauggguacagcauuucuaccaagaggcggcaccagcccaguccgaugucgcuuugcuacgguuugugaacccggacacuggacguguucuguucgaauguaaacuccacaagagcggcuaugugacggucgcccauacagggcagcacgaucuggugauaccucccaacggauacuuucgcuucgacucguggguaaaucaguucuauacccuugcaccaauggguaacggcacugggagaaggcgguga

SEQ ID NO: 21034 - RNA, 1617 nt, Artificial Sequence
  derived and/or modified sequence opt3 from VP1__Norovirus_and/or_Norovirus-like__AB972478
augaagauggccagcuccgacgcuaaccccaccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaagugaucuucgccgcaguaccuccaaauuuuccgacggagggccucucccccucucagguuaccauguucccucauauuguggucgacgugcgccaacuggagccagugcuuaucccccugccugauguccgaaacaauuuuuaucacuacaaccagucgaaugacccaacaauaaaguugaucgcuaugcucuauacuccccugcgugccaacaacgcgggggaugacguuuucaccgugucaugcagaguacugacaaggccgagcccugauuuugacuucauuuuucucgugcccccaaccgucgaaagucggacuaaaccuuucuccgugcccguuuuaacaguggaggaaaugaccaauucucgcuuuccaaucccccuggagaaacuuuucacgggaccuagcuccgccuucgucgugcagccacagaacgguagauguacuaccgauggcguauugcuggggacaacucaacuaucaccgguuaauauuugcaccuuuaggggagacgugacacauaucaccggcagucggaacuacacgaugaaucucgcaagccagaacuggucuaauuaugaucccacugaggaaauaccugcuccacuggguacacccgacuucgucgggaagauucagggagugcuuacccagacuacacgcaccgacggcuccacgcgaggccacaaggccaccgucuacacagggucagcugauuuugccccuaagcugggaagagugcaauucgagacugacaccgaucaugacuuugaagcaaaccagaauacaaaauucacuccaguuggugugauccaggauggcagcaccacacacaggaacgagccccaacaguggguauugccgaguuacucugggcggaauaccccuaacguccaccucgccccagcuguggcgcccacuuuuccuggagaacagcuguuauucuuucguuccacgaugcccggcuguagcgguuauccaaauauggaccuggauugccuccuuccucaggaguggguucaauacuucuaucaggaggcagcccccgcucagucggacguggcccuguugcgcuuugucaacccagauacagggagagugcuauucgaauguaagcugcauaaaucuggcuacguaaccguggcacacacuggacagcaugaccucguuauuccgccuaauggcuauuuuagguucgauuccugggucaaccaauucuacacccuggcccccauggggaacggaacaggucggcgacgcuga

SEQ ID NO: 21035 - RNA, 1617 nt, Artificial Sequence
  derived and/or modified sequence opt3 from VP1__Norovirus_and/or_Norovirus-like__KT780382
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggaccuggauugccuccuuccucaggaguggguucaauacuucuaucaggaggcagcccccgcucagucggacguggcccuguugcgcuuugucaacccagauacgggcagagugcuauucgaauguaagcugcauaaaucuggauacguaacaguggcacacaccggccagcaugaccucguuauuccgccuaauggguauuuuagguucgauuccugggucaaccaauucuacacucuggcccccaugggaaacgguaccggccggcgacgcuga

SEQ ID NO: 21036 - RNA, 1617 nt, Artificial Sequence
  derived and/or modified sequence opt3 from VP1__Norovirus_and/or_Norovirus-like__KT033905
augaagauggccagcaacgacgcuaaucccuccgauggcucugcagccaaccuggugccuaaagucaauaacgagguuauggcgcucgaaccagugguaggggcugccaucgcagccccgguggcuggacagcaaaaugucauugaccccuggauaagaaacaauuucgugcaggcaccugguggcaaguuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggaaccaguccuuaucccccugccugaugugcgaaauaacuuuuaucacuacaaucagucgaacgacucaaccauuaaguugaucgcuaugcucuauacaccacugcgugccaacaaugcgggggaggauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggaaaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaggagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaggcaccacacaccgaaacgaaccccagcaaugggugcucccgagcuacagugguagaaauguucacaacgugcaucuggccccugcaguagcuccaaccuuucccggggagcaguuacuguucuuuaggucuacuaugccuggcuguuccggauaucccaauauggaucucgacugccuucugccacaggaauggguccagcacuucuaccaagaggcggccccugcacagagcgauguggcuuugcuacgguuuguuaaccccgacacgggccgugugcuguucgaguguaaacuccauaagucgggguaugucacaguggcccacaccggacagcacgaucugguaauuccaccgaacgguuacuuucgcuucgacucuugggugaaucaguucuauacucuugcaccuaugggcaacgggaccggaagaaggcgguga

SEQ ID NO: 21037 - RNA, 1617 nt, Artificial Sequence
  derived and/or modified sequence opt3 from VP1__Norovirus_and/or_Norovirus-like__KR904207
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucaacuuucgugguucagccacagaacgguagauguaccacagauggcguguugcuggggacuacccaacuaaguccggucaauauuugcacauuuaggggagacgugacccauaucgcgggcagccacaacuacacgaugaaucucgccucucagaacuggaacuccuaugaucccacugaggaaauuccugcaccacuggguacacccgacuucguagggaagauccagggaguucuuacccagacuacacggaccgacggcucaacgcgcggccauaaggcuaccguguacacagggagcgccgauaguucuccuaagcugggacgaguccaauuugcuacugacaccgauaaugacuucguggccaaucagaacacaaaauuuacuccagucggugugauccaggauggcgggaccgcacacagaaaugagccccaacaguggguuuugccguccuacagcggaaggaacacacacaaugugcaucucgccccugcuguagcgccaaccuuccccggcgaacagcuguuauuuuuccggucgacuaugccugguuguucuggguaucccaacauggaccuggauugccuccuuccacaggaguggguccaauacuuuuaucaggaagcagccccugcucaguccgacguggcccuguugcguuucguuaaucccgauacgggccgcgugcuauuugaguguaagcugcacaaaucaggauacgucacacaggcacauaccggccaacacgaccucgugauuccaccgaacggguauuucagauuugauaguuggguaaaccaguucuacacucuggccccuaugggaaaugguaccggcaggcggcgauga

SEQ ID NO: 21038 - RNA, 1617 nt, Artificial Sequence
  derived and/or modified sequence opt3 from VP1__Norovirus_and/or_Norovirus-like__KJ678151
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaacgccccuggagaaacuuuucaccggaccuuccucagccuucgucgugcagccacagaacgguagauguacuaccgauggcguauugcuggggacaacucaacuaaguccgguuaauaucugcaccuuuaggggagacgugacacauauuaccggcagccggaacuacacgaugaaucucgcaucucagaacugguccaauuaugaucccacugaggaaaucccugcuccacuggguacacccgacuucgucgggaagauacagggagugcuuacccagacuacacgcaccgacggcucaacgcgaggccacaaggccaccgucuacacagggagcgcugauuuugccccuaagcugggaagagugcaauucgagacugacaccgaucaugacuuugaaacaaaccagaauacuaaauucaccccaguuggugugauucaggauggcaguacaacccacaggaacgagccccaacaguggguauugccgucuuacuccgggcggaauacuccuaacguccaccucgcaccagccguggcucccacguuuccuggagaacagcuguuauucuuucguagcacaaugcccggcuguucggguuauccaaauauggaccuggauugccuccuuccucaggaguggguucaauacuucuaucaggaggcggcacccgcccagucugacguggcucuguugcgcuuugucaacccagauaccgggagagugcuauucgaauguaagcugcauaaauccggcuacguaacuguggcccacaccggacagcaugaccucguuaucccgccuaauggcuauuuuagguucgauucaugggucaaccaauucuacacacuggcacccauggggaacggaaccggucggcgacgcuga

SEQ ID NO: 21039 - RNA, 1617 nt, Artificial Sequence
  derived and/or modified sequence opt3 from VP1__Norovirus_and/or_Norovirus-like__KJ678143
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaacgccccuggagaaacuuuucaccggaccuuccucagccuucgucgugcagccacagaacgguagauguacuaccgauggcguauugcuggggacaacucaacuaaguccgguuaauaucugcaccuuuaggggagacgugacacauauuaccggcagccggaacuacacgaugaaucucgcaucucagaacugguccaauuaugaucccacugaggaaaucccugcuccacuggguacacccgacuucgucgggaagauacagggagugcuuacccagacuacacgcaccgacggcucaacgcgaggccacaaggccaccgucuacacagggagcgcugauuuugccccuaagcugggaagagugcaauucgagacugacaccgaucaugacuuugaagcaaaccagaauacaaaauucacuccaguuggugugauucaggauggcaguaccacacacaggaacgagccccaacaguggguauugccgucuuacuccgggcggaauaccccuaacguccaccucgccccagcuguggcgcccacuuuuccuggagaacagcuguuauucuuucguagcacgaugcccggcuguucggguuauccaaauauggaccuggauugccuccuuccucaggaguggguucaauacuucuaucaggaggcagcccccgcucagucugacguggcccuguugcgcuuugucaacccagauacagggagagugcuauucgaauguaagcugcauaaauccggcuacguaaccguggcacacacuggacagcaugaccucguuaucccgccuaauggcuauuuuagguucgauucaugggucaaccaauucuacacccuggcccccauggggaacggaacaggucggcgacgcuga

SEQ ID NO: 21040 - RNA, 1617 nt, Artificial Sequence
  derived and/or modified sequence opt3 from VP1__Norovirus_and/or_Norovirus-like__KP698927
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugguaccaaccagaauacaaaauucacuccaguuggcgugauccaggaugggaguaccacacacaggaacgaaccccaacaguggguauugccgucuuacuccggacggaauaccccuaacguccaccucgcaccagccguggcucccacuuuuccuggcgagcagcuguuauucuuucguagcacgaugcccgguuguucgggguauccaaauauggaccuggauugccuccuuccucaggaauggguucaauacuucuaucaggaggcggcacccgcccagucugacguggcucuguugcgcuuugucaacccagauacaggcagagugcuauucgaguguaagcugcauaaauccggauacguaaccguggcccacacuggccagcaugaccucguuauuccgccuaauggguauuuuagguucgauucaugggucaaccaauucuacacccuggcacccaugggaaacgguacaggccggcgacgcuga

SEQ ID NO: 21041 - RNA, 1617 nt, Artificial Sequence
  derived and/or modified sequence opt3 from VP1__Norovirus_and/or_Norovirus-like__LC005730
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacacacaacguccaucucgccccugcuguggcgccaaccuuucccggcgaacagcuguuauucuuucguuccacuaugccugguuguagcggguaucccaauauggaccuggauugccuccuuccacaggaguggguucaauacuucuaucaggaggcagccccugcucagucggacguggcccuguugcgcuuugucaaccccgauacgggcagagugcuauucgaauguaagcugcacaaaucuggauacguaacaguggcacauaccggccagcacgaccucguuauuccaccgaauggguauuuuagguucgauuccugggucaaccaauucuacacucuggccccuaugggaaacgguaccggccggcgacgcuga

SEQ ID NO: 21042 - RNA, 1617 nt, Artificial Sequence
  derived and/or modified sequence opt3 from VP1__Norovirus_and/or_Norovirus-like__LC005714
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaaugcugacacagaccacuaagggcgacggcuccacacgcgggcacaaggcuaccguuuacacgggaucaacccccuuuacaccuaaauuggguagcgugcaguucaguacugacaccgaaaaugauuuugagacacaucaaaacacuaaguucaccccagucggcgugauccaggacgggucuacaacccaccgaaaugaaccccagcaauggguccucccguccuacagcggaagaaacgugccuaauguucaccuggccccagcaguggcccccacuuuuccuggcgagcaguuacuguucuuuaggucgacgaugcccgguuguucuggguauccaaacauggaucucgacugccuucugccucaggaguggguacagcauuucuaccaagaagcugcgcccgcacaguccgaugucgccuugcuacgguuugugaauccagacacaggccguguucuguucgaguguaaacuccacaagucaggauaugugaccgucgcucauacuggccagcacgaucuggugauuccgccuaacggguacuuucgcuucgacaguuggguaaaccaguucuauacccuugcccccaugggaaaugguacaggcagaaggcgguga

SEQ ID NO: 21043 - RNA, 1617 nt, Artificial Sequence
  derived and/or modified sequence opt3 from VP1__Norovirus_and/or_Norovirus-like__KP241906
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcuaacuuugccccuaagcugggaagagugcaauucgagacagauacugaccaugauuuugaagcaaaucagaacaccaaauucacaccaguuggugugauccaggacggcgggacuacccacaggaaugagccccaacaguggguauugccgaguuacucuggacggaacacaccuaauguccaccucgccccagcuguggcgcccaccuuuccuggcgaacagcuguuauucuuucguuccacuaugcccgguuguagcggguauccaaacauggaucuggacugccuccuuccucaggaguggguucaauacuucuaucaggaggcagcccccgcucagucggauguggcccuguugcgcuuugucaauccagacacgggcagagugcuauucgaauguaagcugcauaaaucuggauacguaacaguggcacacaccggccagcaugaucucguuauuccgccuaacggguauuuuagguucgacuccugggucaaccaauucuacacucuggcccccaugggaaaugguaccggccggcgacgcuga

SEQ ID NO: 21044 - RNA, 1617 nt, Artificial Sequence
  derived and/or modified sequence opt3 from VP1__Norovirus_and/or_Norovirus-like__KM982938
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcuugcugcuagggaccacacaacucaguccgguaaauauuugcacuuuuaggggagacguuacccauaucacaggcagccggaacuacaccaugaaucuggcaucucagaacugguccaauuaugaucccacggaggaaauaccugcuccacuugguacucccgacuucguggggaagauucagggaguccugacacagaccacucgcacagacggcucaacccgaggccacaaggccacgguguacaccgggagcgcugauuuugccccuaaguugggaagaguccaauucgagacagacacugaucaugacuuugaagcaaaccagaauaccaaauucacaccaguggguguuauccaggauggcgggacuacccacaggaacgagccccaacagugggugcucccgaguuacucuggacggaauacaccuaacguacaccuggccccagcugucgcgcccaccuuuccuggcgaacaguuacuguucuuucguuccacuaugcccgguuguagcggguauccaaauauggaccucgauugccuucugccucaggagugggugcaauacuucuaucaggaggcagcccccgcucagucggacguugccuugcuacgcuuugugaacccagauacgggcagaguccuguucgaauguaagcuccauaaaucuggauacgugacaguagcacacaccggccagcaugaccuggugauuccgccuaauggguauuuuagguucgauuccuggguuaaccaauucuacacucuugcccccaugggaaacgguaccggccggcgacgcuga

SEQ ID NO: 21045 - RNA, 1617 nt, Artificial Sequence
  derived and/or modified sequence opt3 from VP1__Norovirus_and/or_Norovirus-like__KM514058
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcuugcugcuagggaccacacaacucaguccgguaaauauuugcacuuuuaggggagacguuacccauaucacaggcagccggaacuacaccaugaaucuggcaucucagaacugguccaauuaugaucccacggaggaaauaccugcuccacuugguacucccgacuucguggggaagauucagggaguccugacacagaccacucgcacagacggcucaacccgaggccacaaggccacgguguacaccgggagcgcugauuuugccccuaaguugggaagaguccaauucgagacagacacugauagggacuuugaagcaaaccagaauaccaaauucacaccaguggguguuauccaggauggcgggacuacccaucggaacgagccccaacagugggugcucccgaguuacucuggacguaauacaccuaacguacaccuggccccagcugucgcgcccaccuuuccuggcgaacaguuacuguucuuucgcuccacuaugcccgguuguagcggguauccaaauauggaccucgauugccuucugccucaggagugggugcaauacuucuaucaggaggcagcccccgcucagucggacguugccuugcuaagauuugugaacccagauacgggcaggguccuguucgaauguaagcuccacaaaucuggauacgugacaguagcacauaccggccagcacgaccuggugauuccgccuaauggguauuuucgguucgauuccuggguuaaccaauucuacacucuugcccccaugggaaacgguaccggccgacgcagauga

SEQ ID NO: 21046 - RNA, 1617 nt, Artificial Sequence
  derived and/or modified sequence opt3 from VP1__Norovirus_and/or_Norovirus-like__KM198580
augaagauggccagcaacgacgcuaaucccaccgauggcuccgcagccaaccuggugccugaggucucuaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagacaaaugacucgacuauuaaguugaucgcuaugcucuauaccccacugcgugccaacaacgcgggggaagauguguucacagucucaugcagaguucugaccaggcccagcccggacuuugauuucauuuuucucgugccucccacuguagagagucggacaaaaccauucaccgugccuaucuuaacggucgaagagaugacuaauucccgcuuucccauaccacuggagaaacuuuucaccggacccucuggugccuucgugguucagccucagaacggcagauguacaacugacgggguguugcugggaaccacacaacuaagcccagucaauauuugcaccuuuaggggcgaugugacgcauaucgcagguucccggaacuacacuaugaaucucgcuucacugaacuggaauaacuaugacccgacagaagagauucccgccccucuugggaccccagauuucguaggaaagauccagggcguucugacucagacaaccaagggcgacgggaguacgcgcggacacaaggcuaccguguacacagguagcgcccccuuuacuccuaaauugggcucuguccaguucuccaccgacacagaaaaugauuuugagacucaucaaaacaccaaguucacaccagugggggucauccaggacggaggcaccacucaccgaaaugaaccccagcaaugggugcucccgucauacagcgguagagauguucacaacgugcaucuggccccugcaguagcuccaacguuucccggggagcaguuacuguucuuuaggaguacaaugccuggcuguucuggauaucccaauauggaccucgauugccuucugccacaggaguggguccagcacuucuaccaagaagcggccccugcacaguccgacguggcuuugcuacgguuuguuaaccccgauaccggccgugugcuguucgaguguaaacuccauaagagcggguaugucacuguggcccacaccggacagcacgaccugguaauuccaccgaaugguuacuuucgcuucgauucgugggugaaccaguucuauacacuugcaccuaugggcaacgggaccggaagaaggcgguga

SEQ ID NO: 21047 - RNA, 1617 nt, Artificial Sequence
  derived and/or modified sequence opt3 from VP1__Norovirus_and/or_Norovirus-like__KM198537
augaagauggcccccaacgacgcuaauccuagcgauggcuccgcagccaaccuggugccagaggucucuaaugaaguuauggcgcucgagccggugguaggggcugccaucgcagcccccguggcuggacagcaaaacgucauugacccuuggauaagaaauaacuucgugcaggcaccagguggcgaauuuaccguuucacccaggaaugccccuggggagauccuuuggggagcuccacugggccccgauuugaacccuuacuuaagucaccuggcccggauguauaaugguuacgcagggggauucgaagugcaggucauucuagcgggcaacgccuuuacagcuggcaaaaucauuuucgccgcagugccaccgaauuuucccacugaggggcucagcccuucccagguaacgauguucccacauaucauaguugacgugcgccaacuggagcccguccuuaucccucugccagaugugcgaaacaauuuuuaucacuacaaccagaccaaugacucuacaauuaaguugaucgcuaugcucuauacuccccugcgugccaacaacgcgggagaagauguguucaccgucucgugcagaguucugacaaggccgucaccugacuuugauuucauuuuucucgugcccccaaccguagagagccggacuaaaccuuucacagugcccaucuuaaccgucgaagagaugacgaauagucgcuuuccaauaccccuggagaaacuuuucacugguccuuccggcgccuucgugguucagccacagaacgggagauguaccacagacggaguguugcugggcacuacccaacuaucuccggucaauauuugcacauuuaggggugaugugacccauaucgcagggagccggaacuacacgaugaaucucgcuucccugaacuggaauaacuaugaccccacugaagagauuccugccccacuuggaacacccgauuucguaggcaagauccagggcguucugacccagacuacaaagggggacggaucaacccgcggucacaaggcuacgguguacaccggcagugccccuuuuacaccaaaauuggggagcguccaguucucuacugacaccgaaaaugauuuugagacacaucaaaacacuaaguucacccccgugggagucauccaggacggcgguacaacccaccgaaaugaaccgcagcaaugggugcucccuuccuacucagggagagauguucacaacgugcaucuggcaccagccguagcucccacuuuuccuggcgagcaguuacuguucuuuaggagcacgaugcccggauguaguggcuauccaaauauggaccucgauugccuucugccucaggaguggguccagcacuucuaccaagaagcggcacccgcccagucugacguggcuuugcuacgguuuguuaacccagauacagggcgugugcuguucgaguguaaacuccauaaguccggauaugucaccguggcccacaauggucagcacgaccugguaauuccgccuaacggcuacuuucgcuucgauagcugggugaaccaguucuauacucuugcacccauggggaauggaaccggcagaaggcgguga

SEQ ID NO: 21048 - RNA, 1617 nt, Artificial Sequence
  derived and/or modified sequence opt3 from VP1__Norovirus_and/or_Norovirus-like__KF177450
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccucauuccacaggaguggguucaauacuucuaucaggaggcagccccugcucagagcgacguggcccuucugcgcuuugucaaucccgauacgggcagaguguuguucgaauguaagcuacacaaaucgggauacguaacaguggcacauaccggccagcacgaccugguuaucccaccgaacggguauuuuagguucgauucuugggucaaccaauucuacacucucgccccuaugggaaaugguaccggccggcgacgcuga

SEQ ID NO: 21049 - RNA, 1617 nt, Artificial Sequence
  derived and/or modified sequence opt3 from VP1__Norovirus_and/or_Norovirus-like__KF008243
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucaacagauuuugcuccuaagcugggaagagugcaauucgagacugacaccgaucaugacuuugaagccaaucagaacacaaaauucacuccaguuggugugauccaggauggcagcaccacacacaggaaugagccccaacaguggguauugccgaguuacucugggcggaacacccacaauguccaucucgccccugcaguggcuccaacuuuucccggagaacagcuguuauucuuucguuccacgaugccuggcuguagcgguuaucccaacauggaccuggauugccuccuuccacaggaguggguucaauacuucuaucaggaggcggccccugcacagucggacguggcucuguugcgcuuugucaaucccgauacagggagagugcuauucgaauguaagcugcacaaaucuggcuacguaaccguggcccauacuggacagcacgaccucguuauuccaccgaacggcuauuuuagguucgauuccugggucaaccaauucuacacccuggcaccuauggggaauggaacaggucggcgacgcuga

SEQ ID NO: 21050 - RNA, 1617 nt, Artificial Sequence
  derived and/or modified sequence opt3 from VP1__Norovirus_and/or_Norovirus-like__KF429782
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccacuucugauccccuugccugauguccgaaacaauuuuuaucacuacaaccagucaaaugacccaacaauuaagcucaucgcaaugcuguauacuccccugcgugcuaacaacgccggggaugacguguucaccgugagcugcagaguccucacaaggccgaguccugauuuugacuucaucuuuuuaguucccccaaccguggaaucccggacuaaaccuuucucuguacccauucugacaauagaggaaaugaccaauagccgcuuuccaauuccccuugagaaguuguucacgggaccuuccucagcguucgugguccagccacagaacgguagauguacuaccgauggcgugcugcuagggacaacucaacucaguccgguuaauaucugcaccuuuaggggagacgugacacauauuaccggcacgcacaacuacgccaugaaucuggcagcucagaacuggaauagcuaugaucccacugaggaaaucccugccccacuugguacacccgacuucgucgggaaaauccagggagugcugacccagacuacacgggcugacggcucuacccgcgcccauaaggcaacgguauacaccggcuccgccgaguuugcuccuaaguuggggcgaguucaauucgcgacagauacugacucagauuuugacaccaaccagaauacaaaauucacuccagugggagucauucaggaugguaacaccgcacaccaaaaugaaccccagcagugggugcucccgagcuacaguggcagaaacaaucacaacguccaucuggccccugcuguggccccaacauuucccggggagcaguuacuguucuuuaggucuaccaugccuggauguuccggcuaucccaauaugaaccucgacugccuucugccacaagaauggguucaguacuucuaucaggaggcagccccugcucagagcgauguggccuugcuacgguuuguaaaccccgacacuggucguguccuguucgaguguaagcuccacaaaucgggguacgugacgguugcacauacaggccaacacgaucuggugauaccaccgaauggauauuuucgcuucgacucuugggucuccccuuucuacacccuugcgcccaugggcaacgggacuggaagaaggcgguga

SEQ ID NO: 21051 - RNA, 1617 nt, Artificial Sequence
  derived and/or modified sequence opt3 from VP1__Norovirus_and/or_Norovirus-like__KF060101
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcgcugacggcagcacacgaggccacaaggccaccgucuacacggggagugcugauuuuucuccuaagcugggaagagugcaauucgccaccgacacagauaaugacuuugucgcaaaucagaacacuaaauucaccccaguggguguuauccaggauggcuccacaacucccaggaaugagccgcaacaguggguguugccuagcuacucggggcggaacacccauaauguacaccucgccccagcugucgcgcccacauuuccuggagaacagcuguuauucuuucguucuaccaugcccggcuguuccgguuauccaaacauggaccuggauugccuccuuccucaggagugggugcaauacuucuaucaggaagcagcccccgcucagucagacguugcccuguugcgcuuugugaauccagauacugggagaguccuauucgaguguaagcugcacaaaaguggcuacgugacgguagcacauacaggacagcacgaccucgugaucccgccuaacggcuauuuuagguucgauagcuggguuaaccaauucuacacccuggcccccauggggaauggaacuggucggcgacgcuga

SEQ ID NO: 21052 - RNA, 1617 nt, Artificial Sequence
  derived and/or modified sequence opt3 from VP1__Norovirus_and/or_Norovirus-like__KF060096
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcuguguuugccccuaagcugggaagaguucaauucgagacagauacugaccaugauuuugaagcaaaccagaauaccaaauucacaccaguggguguaauccaggacggcaguacuacccacaggaacgagccccaacagugggucuugccgucuuacuccgggcggaauacaccuaacgugcaccucgccccagcuguugcgcccaccuuuccuggagaacagcuguuauucuuucguagcacuaugcccggcuguucggguuauccaaauauggaucuggacugccuccuuccucaggagugggugcaauacuucuaucaggaggcagcccccgcucagucugaugucgcccuguugcgcuuugugaacccagacacggggagaguacuauucgaauguaagcugcauaaauccggcuacgugacaguugcacacaccggacagcaugaucucgucauuccgccuaauggcuauuuuagguucgacucaugggugaaccaauucuacacucuggcccccauggggaacggaaccggucggcgacgcuga

SEQ ID NO: 21053 - RNA, 1617 nt, Artificial Sequence
  derived and/or modified sequence opt3 from VP1__Norovirus_and/or_Norovirus-like__KF060071
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucguuucccagaacuggaacucauaugaucccacggaggaaaucccugccccacuggguacucccgacuucguggggaagauucagggaguccuuacacagaccacucgcacaaauggcagcacccgaggccacaaggcaacgguguacaccgggagugcugacuuuucuccuaagcugggaagaguccaauucgccacagauacugacaaugauuuugagaccaaccagaauacaaaauucacuccaguggguguuauccaggacggcuccaccacacccaggaacgaaccgcaacaguggguguugccuagcuacucggggcggaauauccauaacguacaccucgcuccagccgucgcacccaccuuuccuggagagcagcuguuauucuuucguucuacuaugcccggcuguuccgguuauccaaauauggaucuggacugccuccuuccucaggaaugggugcaauacuucuaucaggaggccgcucccgcgcagucagauguugcacuguugcgcuuugugaacccagacacggggagaguccuauucgaguguaagcugcacaaaaguggcuacgugacaguagcccauaccggacagcacgaucucgugauuccgccuaacggcuauuuuagguucgacagcuggguuaaucaauucuacacucuggcucccauggggaacggaaccggucggcgacgcuga

SEQ ID NO: 21054 - RNA, 1617 nt, Artificial Sequence
  derived and/or modified sequence opt3 from VP1__Norovirus_and/or_Norovirus-like__KF060056
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggaggcagccccugcucagagcgacguggcccuguugcgcuuugucaaucccgauacgggcagagugcuauucgaauguaagcugcacaaaucgggauacgcaacaguagcccauaccggccagcacgaccucgugauuccaccgaacggguauuuuagguucgauucuuggguuaaccaauucuacacucuggcuccuaugggaaaugguaccggccggcgacgcuga

SEQ ID NO: 21055 - RNA, 1617 nt, Artificial Sequence
  derived and/or modified sequence opt3 from VP1__Norovirus_and/or_Norovirus-like__JX439836
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccucccugggaccugauuugaacccauacuuaucucaccuggcucggauguauaauggcuacgccgguggguucgaagugcaggucauucuagcgggaaacgcauuuacugccggcaaaaucauuuucgcugccgugcccccuaauuuuccaacggagggccucucgccgucacagguaaccauguucccccauaucauaguugacgugcgccaacuggagccuguccuuaucccacugcccgaugugcgaaacaauuuuuaucacuacaaccagagcaaugacccuacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaauuccgccuaacggcuauuuuagguucgacagcugggugaaucaauucuacacucuggcccccauggggaacggaaccggucggcgacgcuga

SEQ ID NO: 21056 - RNA, 1617 nt, Artificial Sequence
  derived and/or modified sequence opt3 from VP1__Norovirus_and/or_Norovirus-like__HF952129
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauauccccggcagccacaacuacaccaugaaucucgccucucagaacuggaacuccuaugauccuacggaggaaauuccagcaccccuggguacuccugacuucguagggaagauccagggaguucuuacacagaccacucggacaaauggcucaacccgcggccauaaggcuacgguguacaccgggagcgccgacuuuaguccaaagcugggacgaguccaauucgcuacagauacugacaaugauuuugagaccaaccagaauacaaaauucacucccgugggugucauccaggacggcucuaccacaccgagaaacgaaccucaacaguggguguugccauccuacagcgggaggaauauucacaacguucaccucgcccccgcaguggccccuaccuuucccggagagcagcuguuauucuuucggucgacuaugccaggcuguucugguuauccuaauauggaucuggacugccuccuuccccaggaauggguacaauacuucuaucaggaggcugcgccagcacaguccgaugucgcccuguugcguuuugugaacccggacacggggcgcguucuauucgaguguaagcugcauaaaucaggcuacgugacagucgcucacaccggacagcaugaucucgugauaccucccaacggcuauuuuagauucgacaguuggguaaaucaauucuacacucuggccccaauggggaacggaaccgguaggcggcgauga

SEQ ID NO: 21057 - RNA, 1617 nt, Artificial Sequence
  derived and/or modified sequence opt3 from VP1__Norovirus_and/or_Norovirus-like__KC409273
augaagauggccagcaacgacgcuaaucccuccgauggcucugcagccucacuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagaccaacgacagcacaauuaaguugaucgcuaugcucuauacuccacugcgugccaauaacgcgggggaagauguguucaccgucaguugcagaguucugacaaggcccuccccggacuuugauuucauuuuucucgugccucccaccguagagucucggacuaaaccauucacagugccuaucuuaaccgucgaagagaugacgaacagccgcuuucccauaccacuggagaaacuuuucacuggacccuccggugccuucgugguucagccucagaauggcagauguaccacagacgggguguugcugggaacuacccaacuaucaccagucaacauuugcacauuuaggggcgaugugacccauaucgcagguagucggaauuacacgaugaaccucgcuagccugaauuggaacaauuaugacccgacugaagagauucccgccccucuugggacaccagauuucguaggaaagauccagggcguucugacccagacuacaaagggcgacgggucuacccgcggacacaaggcuacgguguacaccgguuccgcccccuuuacaccuaaauugggcucaguccaguucagcacugacaccgaaaacgauuuugagacacaucaaaauacuaaguucaccccagugggggucauccaggacggaggcacaacccaccgaaacgaaccccagcaaugggugcucccgaguuacucugguagagauguucacaaugugcaucuggccccugcaguagcuccaacuuuucccggggagcaguuacuguucuuuagguccacgaugccuggcuguagcggauaucccaacauggaccucgauugccuucugccacaggaguggguccagcacuucuaccaagaagcggccccugcacagucggacgcugccuugcuacgguuugugaaucccgauacaggccguguucuguucgaguguaaacuccauaagucuggguaugugaccgucgcacacacuggacagcacgaccuggugauuccaccgaacgguuacuuucgcuucgauuccuggguaaaucaguucuauacccuugccccuaugggcaacgggacaggaagaaggcgguga

SEQ ID NO: 21058 - RNA, 1617 nt, Artificial Sequence
  derived and/or modified sequence opt3 from VP1__Norovirus_and/or_Norovirus-like__KC409242
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauucccggcucucggaauuacaccaugaaccucgccucccagaauuggaacucauaugauccuacggaggaaaucccagcaccccuggguacuccugacuucguugggaagauucagggagugcuuacacagaccacucgcacaaauggcagcacccgaggccacaaggcuacggucuacaccgggagugccgacuuuucuccaaagcugggaagagugcaauucgcuacagauacugacaacgauuuugagaccaaucagaacacaaaauucacucccgucggugugauccaggacggcuccaccacaccgaggaaugaaccucaacaguggguuuugccaagcuacucggggcggaacauccauaaugugcaccucgcccccgcaguagccccuaccuuucccggagagcagcuguuauucuuucguucuacuaugccaggcuguuccgguuauccuaacauggaucuggacugccuccuuccccaggaauggguccaauacuucuaucaggaggcugcgccagcacagucagauguggcccuguugcgcuuuguuaauccggacacggggagagugcuauucgaguguaagcugcacaaaaguggcuacgucacaguggcucauaccggacagcacgaucucguaauuccucccaacggcuauuuuagguucgacagcugggugaaccaauucuacacucuggccccaauggggaauggaaccggucggcgacgcuga

SEQ ID NO: 21059 - RNA, 1617 nt, Artificial Sequence
  derived and/or modified sequence opt3 from VP1__Norovirus_and/or_Norovirus-like__JX445167
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccacaacuacaccaugaaucucgccucucagaacuggaacuccuaugauccuacggaggaaguuccagcaccccuggguacuccugacuucguggggaagauccagggaguccuuacacagaccacucggacaaauggcucaacccgcggccauaaggcuacgguguacaccgggagcgccgacuuuaguccaaagcugggacgaguccaauucgcuacagauacuaauaacgacuuugagaccaaucagaacacaaaauucacucccguggguguuauucaggauggcucuaccacaccgagaaaugaaccucaacaguggguguugccauccuacagcgggaggaacacccacaauguacaccucgcccccgcagucgccccuacuuuucccggagagcagcuguuauucuuucggucgacgaugccaggcuguucugguuauccuaacauggaccuggauugccuccuuccccaggaaugggugcaauacuucuaucaggaggcugcgccagcacaguccgacguugcccuguugcguuuugugaacccggauacagggcgcguccuauucgaguguaagcugcauaaaucaggcuacgugaccguagcucacacuggacagcaugaccucgugaucccucccaauggcuauuuuagauucgauaguuggguuaaccaauucuacacccuggccccaauggggaauggaacagguaggcggcgauga

SEQ ID NO: 21060 - RNA, 1617 nt, Artificial Sequence
  derived and/or modified sequence opt3 from VP1__Norovirus_and/or_Norovirus-like__JX445156
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugggcgcuaacaacgccggggaugacguguucaccgucaguugccguguucugacaagaccguccccugauuuugacuucauuuuucucgugcccccaaccguagaaucuaggacuaaaccuuucagcgugcccaucuuaacagucgaggaaaugaccaauucccgguuuccaauaccccuggagaaacuuuucacgggaccuucaagugcguucgugguucagccacagaacggucgcuguacuaccgauggcguguugcuggggacaacucaacuaagcccggucaauauuugcaccuuuagaggagacgugacacauaucgccggcacccaggaguacacgaugaaccucgcaucucagaauuggaacaauuaugaucccacugaagagauuccugcuccacuggguacacccgacuucguagggaagauccagggaguucuuacccaaacuacaaggcgggacggcuccacccgcggccacaaggccacggugucaaccgggagcguccauuuuacaccuaagcugggacgaauccaguucaguacugauaccucuaacgacuuugaaacaggucagaauacuagauucaccccagugggcgucgugcaagauggguccacaacccaccagaacgagccccagcaguggguuuugccgaauuacagcggaagggacucgcacaacgugcaucucgcuccugccguagcaccaucuuuucccggcgaacaacuguuauucuuucgguccacuaugccugguuguucaggguaccccaauaugaaccuggauugccuccuuccacaggaguggguccagcacuucuaucaggaggccgcuccugcgcaaagugacguggcacuguugcguuuuguuaaucccgauacgggccgcgugcuauucgaauguaaacugcauaagagcggauacgucacaguggcccacaccggccagcacgaccucguaauuccaccgaacggguauuuuagauucgauuccugggugaaccaguucuacacucuggcuccuaugggaaaugguaccggcaggcggcgauga

SEQ ID NO: 21061 - RNA, 1617 nt, Artificial Sequence
  derived and/or modified sequence opt3 from VP1__Norovirus_and/or_Norovirus-like__GQ856458
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugcccucacagcuggcaaaaucauuuuugccgcagugccuccaaacuucccgacugagggccugucccccucucagguaacgauguuuccucauaucauaguugacgugcgccaacuugagccaguccugauccccuugccugaugugcgaaauaacuucuaucacuacaaucagucgaacgacucaaccauuaagcucaucgcuaugcuguauacaccacugcgugccaacaaugcgggggaagauguguuuacugucagcugcagaguucucaccaggcccaguccggacuucgauuuuauuuucuuagugccucccacaguagagucccggaccaaaccauuuacugugccuauccugacagucgaagagaugaccaacucucgcuuccccauaccacuugagaaguuguuuacgggacccagcuccgccuucgugguucagccucagaaugguagauguacuaccgacggcgugcugcuagggacaacucaacucucaccagucaacauuugcaccuucaggggagaugugacacauaucgcaggcagucggaauuacaccaugaaccuggcuagccuuaauuggaacaauuaugacccgacggaagagauucccgccccucuggguacuccagauuuuguagggaaaauccagggaguucccacacagaccacuaagggcgacggcucuacacgcgggcacaaggcuaccguguacacgggauccgccccuuucaccccaaaauuggguucaguccaguuuagcacagacacugaaaacgauuucgaggcacaucaaaauaccaaguuuacacccgugggcgucauccaggacgggggaacuacccaccgaaacgaaccgcagcaaugggugcucccuaguuacucuggcagaaauguuccaaacgugcaccuggcccccgcuguagcgccuacauuccccggugagcaguuacuguuuuucagguccaccaugccaggguguagcggcuauccuaauauggaucucgacugccuucugccccaggaguggguccagcauuuuuaccaagaagcagccccagcucagucggauguggccuugcuacgguucguuaacccggacacuggacgugugcuguuugaguguaaacuccacaagucuggcuaugucacgguggcacauacagggcagcacgaucugguaauuccucccaacggauacuuccgcuuugacuccugggugaaucaguucuauacccuugccccaauggguaacggcacugggagaaggcgguga

SEQ ID NO: 21062 - RNA, 1617 nt, Artificial Sequence
  derived and/or modified sequence opt3 from VP1__Norovirus_and/or_Norovirus-like__AB541299
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcauuccuuauauuucaggagcacuaugcccggguguucgggcuacccaaauauggaucuggacugccuccuuccucaggaguggguccagcacuuuuaucaggaagcggcacccgcccaaucugauguggcucuguugcgguucguuaacccagacacgggacgugugcuauuugaguguaaacugcauaaguccggcuacgucacaguggcccacaccgggcagcacgaucucguaauuccgccuaacggauauuuccgcuuugacucaugggugaaucaguucuacacucuggcacccauggguaacggcaccgggagaaggcgguga

SEQ ID NO: 21063 - RNA, 1617 nt, Artificial Sequence
  derived and/or modified sequence opt3 from VP1__Norovirus_and/or_Norovirus-like__AB541195
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcaugcugacacagaccacuaagggcgacgggucuacacgcggacacaaggcuaccguuuacacggguuccgcccccuuuaccccuaaauugggcaaugugcaguucucaacagacacugaaaacgauuuugagacccaucaaaauacaaaguucacuccagucggggugauccaggacggaagcaccacacaccgaaacgaaccccagcaauggguccucccgaguuacucuggcagagaugugcacaauguucaucuggccccugcaguggcuccaaccuuucccggugagcaguuacuguucuuuagguccacuaugccuggguguagcggcuaucccaacauggaccucgauugccuucugccacaggaguggguacagcacuucuaccaagaagcggccccugcacagucggacgucgcuuugcuacgguuugugaaucccgauacgggacguguucuguucgaguguaaacuccauaagucuggcuaugugacagucgcccacaccgggcagcacgaccuggugauuccaccgaacggauacuuucgcuucgauuccuggguaaaccaguucuauacucuugcaccuauggguaauggcaccgggagaaggcgguga

SEQ ID NO: 21064 - RNA, 1617 nt, Artificial Sequence
  derived and/or modified sequence opt3 from VP1__Norovirus_and/or_Norovirus-like__AB504322
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucaguugaacgacucgaccauuaagcucaucgcuaugcuguauacaccacugcgugccaacaaugcgggggaagauguguucacugucucaugcagaguucucaccaggcccagcccggacuuugauuucauuuuucuggugccucccacaguagagagucggaccaaaccauucacugugccuauccugacagucgaagagaugaccaacucccgcuuucccauaccacuugagaaguuguucacgggacccucuggugccuucgugguucagccucagaauggcagauguacuaccgacggggugcugcuaggaacaacucaacucagcccagucaacauuugcaccuuuaggggcgaugugacacauaucgcagguucccggaauuacaccaugaaccuggcuucacuuaauuggaacaauuaugacccgacggaagagauucccgccccucuggggacuccaggauucguaggcaaaauccagggcguuuugacacagaccacuaagggggauggaaguacacgcggucacaaggcuaccguguacacgggcagcgcccccuuuaccccuaaacucgggucuguccaguucuccacagacacugaaaacgacuuugagacccaucaaaauacaaaguucacuccagugggagucauccaggauggcucaaccacacaccgaaacgaaccccagcaaugggugcugccgagcuacagugguagaaauguucacaacgugcauuuagccccugcaguagcuccaaccuuucccggggagcaguuacucuucuuuaggucuacuaugccuggcuguuccggauaucccaauauggaccuugauugccuguugccacaggaguggguccagcacuucuaccaagaagcggccccugcacagagcgacguggcucuacugcgguuuguuaaccccgauacgggccguguccucuucgaguguaaacugcauaagucgggguaugugacaguggcccacaccggacagcacgaccuuguaauuccaccgaacgguuacuuucgcuucgauucuugggugaaucaguucuauacucuggcaccuaugggcaacgggaccggaagaaggcgguga

SEQ ID NO: 21065 - RNA, 1617 nt, Artificial Sequence
  derived and/or modified sequence opt3 from VP1__Norovirus_and/or_Norovirus-like__EU876892
augaagauggccagcaacgacgcuaaucccuccgauggcucugcagccaaccuggugcucgaggucaauaacgaaguuauggcgcuugagccugugguaggggcugccaucgcagccccaguggcuggacagcaaaaugucauugacccguggauaagaaacaauuucgugcaggcacccgguggcgaauuuaccguuucaccuaggaacgccccaggggagauccuguggagugcucccuugggaccugauuuaaauccauaccugagccaccuagcccggauguauaacggcuacgcggguggguucgaagugcaggucauucucgcaggaaaugccuuuacagcuggcaaaaucauuuucgccgcagugcccccuaacuuuccaacugagggccuguccccgucucagguaacgauguucccccauaucauaguugacgugcgccaacuugagccuguccugaucccauugcccgaugugcgaaauaacuuuuaucacuacaaucagucgaacgacucaaccauuaagcucaucgcuaugcuguauacaccucugcgugccaacaaugcgggggaagauguguucacugucagcugcagaguucucaccaggccaagucccgacuuugauuucauuuuucuggugccgccuacaguagagucccggaccaaacccuucacugugccaauccugacagucgaagagaugaccaacucucgcuuuccuauaccccuugagaaguuguucacgggaccaagcggugccuucgugguucagccccagaauggcagauguacuaccgacggggugcugcuaggaacaacucaacucuccccugucaacauuugcaccuuuaggggcgaugugacacauaucgcagguucacggaauuacaccaugaaccuggcuagucuuaauuggaacaauuaugacccaacggaagagauuccggcuccccuggggacuccugauuucguaggaaaaauccagggcguuuugacacagaccacuaagggcgacgggagcacacgcggacacaaggccaccguguacacggguucugccccauuuacccccaaacucggcuccguccaguucucaacagacacugaaaacgauuuugagacccaucaaaauacaaaguucacuccugugggggucauccaggacggaagcaccacacaccgaaacgaaccacagcaaugggugcugcccaguuacucuggcagaaauguucacaacgugcauuuagcaccggccguagcuccuaccuuuccaggugagcaguuacucuucuuuagguccacuaugcccggguguagcggcuauccuaauauggaucuugacugccuguugccccaggaguggguccagcacuucuaccaagaagcggcaccagcccagucggauguggcucuacugcgguuuguuaacccugacacgggacguguccucuucgaguguaaacugcauaagucuggcuaugugacaguggcccacaccgggcagcacgaucuuguaauucccccaaacggauacuuucgcuucgacuccugggugaaucaguucuauacucuggcaccgauggguaacggcaccgggagaaggcgguga

SEQ ID NO: 21066 - RNA, 1617 nt, Artificial Sequence
  derived and/or modified sequence opt3 from VP1__Norovirus_and/or_Norovirus-like__EU876891
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaaaagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaggaaauucccgccccucuugggacuccagauuucguaggaaagauccagggcguucugacacagaccacuaagggcgacgggucuacacgcggacacaaagcuaccguguacacggguuccgcccccuuuaccccuaaguugggcucaguccaguucagcacagacacugagaaugauuuugaaacccaucaaaacacaaaauucacuccagugggggucauccaggacggaaguaccacacaccgaaaugagccccagcaaugggugcucccgucuuacuccggcagaaacguucacaaugugcaucuggccccugcaguagcuccaaccuuucccggugaacaguuacuguucuuuaggagcacuaugccuggguguucgggcuaucccaacauggaucucgacugccuucugccacaggaguggguccagcacuucuaccaagaggcggccccugcacagucugauguggcuuugcuacgguuuguuaaucccgacacgggacgugugcuguucgaauguaagcuccauaaauccggcuaugucacaguggcccacaccgggcagcacgaucugguaauuccaccgaacggauacuuucgcuucgacucaugggugaaccaguucuauacucuugcaccuauggguaauggcaccgggagaaggcgguga

SEQ ID NO: 21067 - RNA, 1617 nt, Artificial Sequence
  derived and/or modified sequence opt3 from VP1__Norovirus_and/or_Norovirus-like__AB294792
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgacgugcaggucauucuagcgggaaacgcauuuacugccggcaaaaucauuuucgcugccgugccuccaaauuuuccgacggaaggccucucucccucgcagguaaccauguucccucauaucauaguugaugugcgccaacuggagccaguccuuaucccccugccugacgugcgaaacaauuuuuaucacuacaaccagucaaaugauagcacaauuaaguugaucgcaaugcucuauacuccacugcgugcuaacaacgccggggacgauguguucaccgucaguugcagaguucugacaaggcccuccccggacuuugauuucauuuuucucgugccucccaccguagagucucggacuaaaccauucacagugccuaucuuaaccgucgaagagaugacgaauagccgcuuucccauaccacuggaaaaacuuuucacuggacccuccucagcguucgugguucagccucagaacgguagauguaccacagacggcguguugcuggggacuacccaacuaaguccagucaauauuugcacauuuaggggagaugugacccauaucccgggcacgcggacuuaccgcaugaaccucgccagccagaauuggaacaauuaugaccccacagaggagauuccugcaccacuggguacccccgacuucguagggaagauccagggaaugcuuacucagacaaccaagggcgauggcucuacgcgagggcacaaggcuaccguuuccacaggaucaguggacuuuacuccuaaacuggguagcguccaauucgccaccgauacagacaacgauuuugaaacuggccagaauaccagauucacaccagugggggucauccaggacggaaguucuacccauaggaacgagccccaacaguggguguugccggauuacuccggccggacuguucacaaugugcaccucgcuccugccguagcaccaacguuucccggugaacagcuguuauucuuucguagcacaaugccuggguguucgggcuaccccaacauggaccuggauugccuccuuccacaggaguggguccaacauuucuaucaggaagccgcuccuucucaguccgacguggcgcuguugcgcuuuguuaaucccgauaccggaagagugcuauucgaguguaagcugcacaaagcaggcuacgucacuguggcccauaccgggcagcacgaccucguaauuccaccgaacggauauuuuagguucgacucaugggugaaucaauucuacacacuggcuccuauggguaacggcgccgggcggcgacgcuga

SEQ ID NO: 21068 - RNA, 1617 nt, Artificial Sequence
  derived and/or modified sequence opt3 from VP1__Norovirus_and/or_Norovirus-like__AB303932
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcguccaauucaacaccgauacaaauaacgacuuugaaacugggcagaauaccagauucacaccagugggagucgugcaggauggcaacgguacccaccaaaaugagccccagcaguggguuuugccgucuuacuccgggaggacuggccauaacgugcaccucgcuccugccguagcaccaacguuucccggagaacagcuguuauucuuucggucaacaaugccuggcuguagcggguaccccaacaugaaucuggacugccuccuuccacaagaguggguccagcauuucuaucaggaggccgcuccugcgcagagugauguggcacuguugcguuuuguuaaccccgacaccggacgcgugcuauucgaauguaagcugcacaaaucugguuacgucacuguggcccacaccggccaacaugaucucguaaucccaccgaauggguauuuuagauucgacuccugggugaaccaguucuacacacuggcuccuaugggaaauggcaccgguaggcggcgauga

SEQ ID NO: 21069 - RNA, 1617 nt, Artificial Sequence
  derived and/or modified sequence opt3 from VP1__Norovirus_and/or_Norovirus-like__LC177660
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggaaugcuuacacagaccacucgcacagacggcuccacccgaggccacaaggccacgguguacaccgggucagcugauuuugccccuaagcugggaagaguccaauucgagacagacacugaucaugacuuugaagcaaaucagaacaccaaauucacaccaguggguguuauccaggauggcagcacuacccacaggaaugagccccaacaguggguguugccgaguuacucugggcggaacacaccuaauguacaccucgccccagcugucgcgcccaccuuuccuggagaacagcuguuauucuuucguuccacuaugcccggcuguagcgguuauccaaacauggaccuggauugccuccuuccucaggagugggugcaauacuucuaucaggaggcagcccccgcucagucggacguugcccuguugcgcuuugugaauccagauacggggagaguccuauucgaauguaagcugcauaaacucggcuacgugacaguagcacacaccggacagcaugaccuggugauuccgccuaacggcuauuuuagguucgauucuuggguuaaccaauucuacacucuugcccccauggggaauggaaccggucggcgacgcuga

SEQ ID NO: 21070 - RNA, 1617 nt, Artificial Sequence
  derived and/or modified sequence opt3 from VP1__Norovirus_and/or_Norovirus-like__KX608866
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucgccaaucagaacaccaaauucacaccaguggguguuauccaggauggcuccacuacccccaggaaugagccgcaacaguggguguugccuagcuacucggggcggaacacacauaauguacaccucgcaccagccgucgcucccaccuuuccuggagaacagcuguuauucuuucguucuacuaugcccggcuguuccgguuauccaaacauggaccuggauugccuccuuccucaggagugggugcaauacuucuaucaggaagcggcacccgcccagucagacguugcucuguugcgcuuugugaauccagauacggggagaguccuauucgaguguaagcugcacaaaaguggcuacgugacaguagcccauaccggacagcacgaccucgugaucccgccuaacggcuauuuuagguucgauagcuggguuaaccaauucuacacucuggcacccauggggaauggaaccggucggcgacgcuga

SEQ ID NO: 21071 - RNA, 1617 nt, Artificial Sequence
  derived and/or modified sequence opt3 from VP1__Norovirus_and/or_Norovirus-like__KX371603
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaucaggcuacgucacaguggcucauaccggacagcacgaucucguaauuccucccaacggcuauuuuagguucgacaguugggugaaucaauucuacacucuggccccaauggggaacggaaccggucggcgacgcuga

SEQ ID NO: 21072 - RNA, 1617 nt, Artificial Sequence
  derived and/or modified sequence opt3 from VP1__Norovirus_and/or_Norovirus-like__KX354086
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaauuccugcaccacuggguacucccgacuucguagggaagauccagggaguucuuacacagaccacuagcacaaauggcaguacccggggccauaaggcuacgguguacaccgggucugccgacuuuuccccuaagcugggacgcguccaauucgcuacagauacuaaugacgauuuugagaccaaccagaauacaaaauucacuccagugggugucauccaggacggcagcaccacaccccgaaacgaaccgcaacaguggguguugccuucguacucugggagaaauacccacaacguucaccucgccccagcaguggcccccacuuuuccuggagagcagcuguuauucuuuagguccacgaugcccggcuguucagguuauccaaauauggaucuggacugccuccuuccucaggaauggguacaauacuucuaucaggaggcugcgcccgcacagagugaugucgcccuguugcgguuugugaacccagacacagggcguguucuauucgaguguaagcugcauaaaagcggcuacgugaccgucgcucacacuggacagcaugaucucgugauuccgccuaacggcuauuuucgcuucgacuccuggguaaaucaauucuacacccuggcccccauggggaacggaacagguagaaggcgguga

SEQ ID NO: 21073 - RNA, 1617 nt, Artificial Sequence
  derived and/or modified sequence opt3 from VP1__Norovirus_and/or_Norovirus-like__KX354080
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucaccaaucagaacacaaaauucacuccaguggguguuauccaggauggcuccaccacacccaggaaugagccgcaacaguggguguugccuagcuacucggggcggaacacccauaauguacaccucgccccagcagucgcccccacuuuuccuggagaacagcuguuauucuuucguucuacgaugcccggcuguuccgguuauccaaacauggaccuggauugccuccuuccucaggagugggugcaauacuucuaucaggaagcugcgcccgcacagucagacguugcccuguugcgcuuugugaauccagauacagggagaguccuauucgaguguaagcugcacaaaaguggcuacgugaccguagcucauacuggacagcacgaccucgugaucccgccuaacggcuauuuuagguucgauagcuggguuaaccaauucuacacccuggcccccauggggaauggaacaggucggcgacgcuga

SEQ ID NO: 21074 - RNA, 1617 nt, Artificial Sequence
  derived and/or modified sequence opt3 from VP1__Norovirus_and/or_Norovirus-like__KX354054
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaauuccgccuaacggcuauuuuagguucgacagcugggugaaucaauucuacacucuggcccccauggggaacggaaccggucggcgacgcuga

SEQ ID NO: 21075 - RNA, 1617 nt, Artificial Sequence
  derived and/or modified sequence opt3 from VP1__Norovirus_and/or_Norovirus-like__KX354041
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucuuuacccgugcugacagucgaggaaaugaccaauagccgcuuuccaaucccccuugagaaguuguucacgggaccuuccucagcguucgugguucagccacagaacgguagauguacuaccgauggcgugcugcuagggacaacucaacucaguccggucaauauaugcaccuuuaggggagacgugacacauauuagcggcucucggaacuacaccaugaaucuggccucccagaacuggaacucauaugaucccacggaggaaaucccugcaccacuugguacucccgacuucguagggaaaauucagggaguucugacacagaccacucgcacaaauggcagcacccgaggccacaaggcuacgguguacaccgggagugucgacuuuucuccuaaguugggaagagugcaauucgccacagauacugacaaugauuuugagaccaaccagaauacaaaauucacuccagucggugugauccaggacggcuccaccacacccaggaacgaaccgcaacaguggguucucccuagcuacucggggcggaauauccauaacgugcaccuggcuccagccguagcacccaccuuuccuggagagcaguuacuguucuuucguucuacuaugcccggcuguuccgguuauccaaauauggaucucgacugccuucugccucaggaauggguccaauacuucuaucaggaggccgcucccgcgcagucagauguggcauugcuacgcuuuguuaacccagacacggggagagugcuguucgaguguaagcuccacaaaaguggcuacgucacaguggcccauaccggacagcacgaucugguaauuccgccuaacggcuauuuuagguucgacagcugggugaaucaauucuacacucuugcucccauggggaacggaaccggucggcgacgcuga

SEQ ID NO: 21076 - RNA, 1617 nt, Artificial Sequence
  derived and/or modified sequence opt3 from VP1__Norovirus_and/or_Norovirus-like__KX354029
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaacuccugcuccacuggguacacccgacuucgucgggaagauacagggagugcuuacccagacuacacgcaccgacggcuccacgcgaggccacaaggccaccgucuacacagggucagcugauuuugccccuaagcugggaagagugcaauucgagacugacaccgaucaugacuuugaagcaaaucagaacacaaaauucacuccaguuggugugauucaggauggcagcaccacacacaggaaugagccccaacaguggguauugccgaguuacucugggcggaacacccacaauguccaucucgccccugcuguggcgccaacuuuucccggagaacagcuguuauucuuucguuccacgaugccuggcuguagcgguuaucccaacauggaccuggauugccuccuuccacaggaguggguucaauacuucuaucaggaggcagccccugcucagucggacguggcccuguugcgcuuugucaaucccgauacagggagagugcuauucgaauguaagcugcacaaaucuggcuacguaaccguggcauauacuggacagcaugaccucguuaucccaccgaacggcuacuuuagguucgauuccugggucaaccaauucuauacccuggccccuauggggaauggaacaggucggcgacgcuga

SEQ ID NO: 21077 - RNA, 1617 nt, Artificial Sequence
  derived and/or modified sequence opt3 from VP1__Norovirus_and/or_Norovirus-like__KX353977
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcgggaccacacccaggaacgaaccgcaacaguggguuuugccuuccuacagcggacggaauauccauaacgugcaccucgccccagcaguagcccccaccuuuccuggcgagcagcuguuauucuuucguucgacuaugcccgguuguucuggguauccaaauauggaucuggacugccuccuuccucaggaauggguccaauacuucuaucaggaggcugcgcccgcacaguccgauguggcccuguugcgcuuuguuaacccagacacgggcagagugcuauucgaguguaagcugcacaaaucaggauacgucacaguggcucauaccggccagcacgaucucguaauuccgccuaacggguauuuuagguucgacaguugggugaaucaauucuacacucuggcccccaugggaaacgguaccggccggcgacgcuga

SEQ ID NO: 21078 - RNA, 1617 nt, Artificial Sequence
  derived and/or modified sequence opt3 from VP1__Norovirus_and/or_Norovirus-like__KX353965
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauacccccggcagccacaacuacacgaugaaucucgccucucagaacuggaacuccuaugauccuacugaggaaauuccagcaccccuggguacaccugacuucguugggaagauccagggagugcuuacccagacuacacggaccaauggcucaacgcgcggccauaaggcuaccgucuacacagggagcgccgacuuuaguccaaagcugggacgagugcaauucgcuacugauaccgacaaugauuuugagacaaaccagaauacuaaauucacccccgucggugugauucaggacggcucuacaaccccgagaaacgaaccucaacaguggguuuugccauccuacagcgggaggaauauccacaacgugcaccucgcccccgcaguagccccuacuuuucccggagagcagcuguuauucuuucggucgacgaugccaggcuguucugguuauccuaauauggaucuggacugccuccuuccccaggaauggguccaauacuucuaucaggaggcugcgccagcacaguccgauguggcccuguugcguuuuguuaacccggacacagggcgcgugcuauucgaguguaagcugcauaaaucaggcuacgucaccguggcucacacuggacagcaugaucucguaaucccucccaacggcuauuuuagauucgacaguugggugaaucaauucuacacccuggccccaauggggaacggaacagguaggcggcgauga

SEQ ID NO: 21079 - RNA, 1617 nt, Artificial Sequence
  derived and/or modified sequence opt3 from VP1__Norovirus_and/or_Norovirus-like__KU311158
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcgccgacggcucaacacgaggccacaaggcuaccgucuacacggggagcgccgauuuugcaccuaagcugggaagagugcaauucgagaccgacacagaucaugacuuugaagccaaccagaauacuaaauucaccccaguuggugugauccaggauggcgggacaacucacaggaacgagccccaacaguggguauugccgaguuacucuggacggaauaccccuaacguccaccucgcuccagcgguggcacccacauuuccuggcgaacagcuguuauucuuucguuccaccaugcccgguuguagcggguauccaaauauggaccuggauugccuccuuccucaggaguggguucaauacuucuaucaggaggccgcucccgcccagucggacguggcacuguugcgcuuugucaacccagauacuggcagagugcuauucgaauguaagcugcauaaaucuggauacguaacgguggcccacacaggccagcaugaccucguuauuccgccuaauggguauuuuagguucgauuccugggucaaccaauucuacacccuggcucccaugggaaacgguacuggccggcgacgcuga

SEQ ID NO: 21080 - RNA, 1617 nt, Artificial Sequence
  derived and/or modified sequence opt3 from VP1__Norovirus_and/or_Norovirus-like__AB974408
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccacacccuccccggacuuugauuucauuuuucucgugccucccaccguagagucuaggacuaaaccauucacagugccuaucuuaaccgucgaagagaugacgaauagccgguuucccauaccacuggagaaacuuuucacuggacccuccucagccuucgugguucagccucagaacggucgcuguaccacagacggcguguugcuggggacuacccaacuaaguccagucaauauuugcacauuuagaggagaugugacccauaucgcaggcagcaggaacuacacgaugaaucucgcuucucugaacuggaauaacuaugacccgacugaagagauucccgccccucuugguacaccagauuucguagggaagauccagggaaugcugacccagacuacaaagggcgacggcuccacccgggggcacaaggcuacgguuuacaccggaucagcccccuuuacaccuaaauuggguagcgugcaguucaguacugacaccgaaaaugauuuugagacacaucaaaacacuaaguucaccccagucggcgugauccaggacgggaauacaacccaccgcaacgaaccccagcaauggguccucccgucuuacuccggacgaaaugugccuaacguucaccuggcaccagccguggcucccacuuuuccuggcgagcaguuacuguucuuuagaagcacgaugcccgguuguucgggguauccaaauauggaucucgacugccuucugccucaggaguggguacagcauuucuaccaagaagcggcacccgcccagucugaugucgcuuugcuaagguuugugaacccagacacaggccggguucuguucgaguguaaacuccacaaguccggauaugugaccgucgcccauacuggccagcacgaucuggugauuccgccuaacggguacuuucguuucgacucauggguaaaucaguucuauacccuugcacccaugggaaacgguacaggccgcagaagguga

SEQ ID NO: 21081 - RNA, 1617 nt, Artificial Sequence
  derived and/or modified sequence opt3 from VP1__Norovirus_and/or_Norovirus-like__KR904221
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacugggugcccccgacuucgucgggaagauucagggaaugcuuacucagacaacccgcgcugacggcuccacucgaggccacaaggccacaguguacaccgggucagcagauuuugccccuaagcugggaagaguccaauucgagacggacaccgaucaugacuuugaagcuaaucagaacacaaaauucacuccaguggguguuauccaggauggcagcaccacacacaggaaugagccccaacaguggguguugccgaguuacucugggcggaacacucacaauguacaucucgcgccugcagucgccccaaccuuucccggagaacagcuguuauucuuucguuccacaaugccuggcuguagcgguuaucccaacauggaccuggauugccuccuuccacaggagugggugcaauacuucuaucaggaggcugccccugcacagucggacguugcccuguugcgcuuugugaaucccgauaccgggagaguccuauucgaauguaagcugcacaaaucuggcuacgugacuguagcucauacgggacagcacgaccucgugauuccaccgaacggcuauuuuagguucgauuccuggguuaaccaauucuacacacuggccccuauggggaauggagcaggucggcgacgcuga

SEQ ID NO: 21082 - RNA, 1617 nt, Artificial Sequence
  derived and/or modified sequence opt3 from VP1__Norovirus_and/or_Norovirus-like__AB933765
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgaaccucugggaccagauuugaaccccuacuuaucccaccuggcccggauguauaauggcuacgcugguggguucgaggugcaggucauucuagccggaaacgcguuuacugcaggcaaaaucauuuucgccgcugugccuccaaauuuuccgacggagggccucucucccucgcagguaaccauguucccucauaucauaguugacgugcgccaacuggaaccaguccuuaucccccugccugaugugcgaaacaauuuuuaucacuacaaccagucaaaugacagcacaauuaaguugaucgccaugcucuauacuccacugcgugcaaacaacgcuggggaugacguguucaccgucaguugcagaguucugacaaggcccuccccggauuuugacuucauuuuucucgugccucccaccguagagucucggacuaaaccauucagcgugccugucuuaacaguggaagagaugaccaauucccgcuuucccaucccacuggagaaacuuuucacgggacccucaagugccuucguugugcagccucagaacgguagauguacuaccgauggcgucuugcuggggacaacucaacuaagcccagugaauauaugcaccuuuaggggagacguaacacauauuccgggcucucggaacuacaccaugaaucucgcgucccagaacuggaacucauaugaucccacggaagagaucccugccccacuggguacucccgacuucguugggaagauucagggagugcuuacacagaccacucgcacaaauggcagcacccgaggccacaaggcaacggucuacaccgggagugcugacuuuucuccuaagcugggaagagugcaauucgccacagauacugacaaugauuuugaaaccaaccagaauacaaaauucacuccagucggugugauccaggacggcgggaccacacauaggaacgagccccaacaguggguuuugccguccuacagcggacggaauauccacaacgugcaccucgcuccugccguagcaccaaccuuucccggcgaacagcuguuauucuuucguucgacuaugccugguuguucuggguaucccaauauggaucuggacugccuccuuccacaggaguggguccaauacuucuaucaggaggccgcuccugcgcaguccgauguggcacuguugcgcuuuguuaaccccgacacgggcagagugcuauucgaauguaagcugcauaaaucaggauacgucacaguggcccacaccggccagcaugaucucguaauuccaccgaacggguauuuuagguucgacaguugggugaaucaauucuacacucuggcuccuaugggaaacgguaccggccggcgacgcuga

SEQ ID NO: 21083 - RNA, 1617 nt, Artificial Sequence
  derived and/or modified sequence opt3 from VP1__Norovirus_and/or_Norovirus-like__AB933761
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaucaauuucgugcaggcuccugguggcgaauuuacaguuaguccaaggaacgcacccggggagauucuuuggagcgccccucugggaccagauuugaaucccuacuuaucccaccuggcucggauguauaacggcuacgccgguggguucgaagugcaggucauccuagcgggaaaugcauuuacugccggcaaaauuaucuucgcugccgugccuccaaacuuuccgacggagggccucucucccucgcagguaaccauguucccucauauaaucguugacgugcgccaacuggagccaguccuuauuccccugccugaugugcgaaauaacuuuuaucacuacaaucagucaaacgacccaacaaucaaguugauugcaaugcucuauacuccccugcgugcuaauaacgccggggaugacguguucaccgucagcugcagaguucugacaaggccgaguccugauuuugacuucaucuuucucgugcccccaaccguagaaucccggacuaaaccuuucucugugcccgucuuaacaguggaggaaaugaccaacagccgcuuuccaauaccccuggagaaacuuuucacgggaccuuccucagcguucguugugcagccacagaaugguagauguacuaccgauggcgucuugcuggggacaacucaacuaaguccggugaacauuugcaccuuuaggggagacguaacacauauccccggcagccggaauuacaccaugaaccucgccucucagaauuggaacuccuaugauccuacggaggaaauuccagcaccccuggguacuccugacuucguugggaagauccagggagugcuuacacagaccacucgcacaaauggcucaacccgaggccacaaggcuacggucuacaccgggagcgccgacuuuaguccaaagcugggaagagugcaauucgcuacagauacugacaacgauuuugagaccaaucagaacacaaaauucacucccgucggugugauccaggacggcucuaccacaccgaggaaugaaccucaacaguggguuuugccauccuacagcgggcggaacauucauaaugugcaccucgcccccgcaguagccccuaccuuucccggagagcagcuguuauucuuucguucgacuaugccaggcuguucugguuauccuaacauggaucuggacugccuccuuccccaggaauggguccaauacuucuaucaggaggcugcgccagcacaguccgauguggcccuguugcgcuuuguuaauccggacacggggagagugcuauucgaguguaagcugcacaaaucaggcuacgucacaguggcucauaccggacagcacgaucucguaauaccucccaacggcuauuuuagguucgacaguugggugaaccaauucuacacucuggccccaauggggaauggaaccggucggcgacgcuga

SEQ ID NO: 21084 - RNA, 1617 nt, Artificial Sequence
  derived and/or modified sequence opt3 from VP1__Norovirus_and/or_Norovirus-like__AB933748
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcggaacucugggcccugauuugaacccauacuuaucccaccuggcccggauguauaaugguuacgcugggggauucgaagugcaggucauucuagccggcaacgcguuuacggcaggcaaaaucauuuucgccgcugugcccccuaauuuuccaaccgaggggcucucuccgucgcagguaacaauguucccccauaucauaguugacgugcgccaacuggagccuguccuuaucccacugcccgaugugcgaaacaauuuuuaucacuacaaccagucaaaugacccuacuauuaaguugaucgccaugcucuauaccccacugcgugcaaacaacgcuggagaugacguguucacagucagcugcagaguucugaccaggcccaguccggauuuugacuucauuuuucucgugccucccacuguagaaucccggacaaaaccauucucugugccugucuuaaccguggaggaaaugacgaauagccgcuuucccaucccacuggagaaacuuuucacuggucccuccucagccuucguugugcagccucagaacggcagauguaccacagauggggucuugcugggaacuacccaacuaaguccagugaauauaugcacauuuaggggcgacguaacccauauuccggguagccggaacuacacgaugaaucucgcgucucagaacuggaacuccuaugaucccacugaggaaaucccugccccacuggggacacccgacuucguuggaaagauucagggcgugcuuacccagacuacacgcaccaauggcucaacgcgagggcacaaggcaaccgucuacacaggaagcgcugacuuuaguccuaagcuggguagagugcaauucgccacugauaccgacaaugauuuugagacaaaccagaauacuaaauucaccccagucggcgugauccaggacgggucuacaacccccaggaacgaaccgcaacaguggguuuugccuuccuacagcggacggaauauccauaacgugcaccucgcuccagccguagcacccacuuuuccuggcgagcagcuguuauucuuucguucgacgaugcccgguuguucuggguauccaaauauggaucuggacugccuccuuccucaggaauggguccaauacuucuaucaggaggccgcucccgcgcaguccgauguggcacuguugcgcuuuguuaacccagacacaggcagagugcuauucgaguguaagcugcacaaaucaggauacgucaccguggcccauacuggccagcacgaucucguaauuccgccuaacggguauuuuagguucgacaguugggugaaucaauucuacacccuggcucccaugggaaacgguacaggccggcgacgcuga

SEQ ID NO: 21085 - RNA, 1617 nt, Artificial Sequence
  derived and/or modified sequence opt3 from VP1__Norovirus_and/or_Norovirus-like__EU921386
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugauccauauugcagguagucggaacuacacaaugaaucucgcuagccugaacuggaauaacuaugacccgaccgaagagauccccgccccucuugggacgccagauuucguaggaaagauccagggcguucugacucagacaaccaagggcgacgggucuacucgcggacacaaggcuacaguguacaccgguuccgcccccuuuacgccuaaauugggcucaguccaguucagcaccgacacagaaaaugauuuugaggcacaucaaaacacuaaguucaccccagugggggucauucaggacggaggcacaacucaccgaaaugaaccccagcaaugggugcucccgaguuacucugguagaaacguucacaaugugcaucuggccccugcuguagcgccaaccuuucccggggagcaguuacuguucuuuagguccacaaugccuggcuguagcggauaucccaacauggaucucgacugccuucugccacaggaguggguccagcacuucuaccaagaagcagccccugcucagucggauguggccuugcuacgguuuguuaaucccgacaccggccgugugcuguucgaguguaaacuccauaagucuggguaugucacuguggcacacacgggacagcacgaucugguaauaccaccgaacgguuacuuucgcuucgacuccugggugaaccaguucuauacacuugccccuaugggcaaugggaccggaagaaggcgguga

SEQ ID NO: 21086 - RNA, 1617 nt, Artificial Sequence
  derived and/or modified sequence opt3 from VP1__Norovirus_and/or_Norovirus-like__KP244321
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggauguugccuagcuacucggggcggaauacccauaacguucaccucgccccagcaguggcccccacuuuuccuggagagcagcuguuauucuuucguucuacgaugcccggcuguuccgguuauccaaauauggaucuggacugccuccuuccucaggaauggguacaauacuucuaucaggaggcugcgcccgcacagucagaugucgcccuguugcgcuuugugaacccagacacagggagaguucuauucgaguguaagcugcacaaaaguggcuacgugaccgucgcucauacuggacagcacgaucucgugaucccgccuaacggcuauuuuagguucgacagcuggguaaaucaauucuacacccuggcccccauggggaacggaacaggucggcgacgcuga

SEQ ID NO: 21087 - RNA, 1617 nt, Artificial Sequence
  derived and/or modified sequence opt3 from VP1__Norovirus_and/or_Norovirus-like__KP698923
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacuaaccacgauuuugaagcaaaucagaacaccaaauucacaccaguuggugugauccaggacggcgggacuacccacagaaaugagccccaacaguggguauugccgaguuacucuggaaggaacacaccuaauguccaucucgccccagcugcggcacccaccuuuccuggcgaacagcuguuauucuuucgguccacuaugcccgguuguagcggguauccaaacauggaucuggacugccuccuuccucaggagugggugcaauacuucuaucaggaggccgcucccgcccagucggauguugcacuguugcguuuugugaauccagacacgggccgcguccuauucgaauguaagcugcacaaaucuggauacgugacaguagcccauaccggccagcacgaucucgugauuccgccuaacggguauuuuagauucgacuccuggguuaaccaauucuacacucuggcucccaugggaaaugguaccggcaggcggcgauga

SEQ ID NO: 21088 - RNA, 1617 nt, Artificial Sequence
  derived and/or modified sequence opt3 from VP1__Norovirus_and/or_Norovirus-like__KP241905
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcgcgucauucuagcaggaaacgccuuuacagcuggcaaagugaucuucgccgcaguaccuccaaauuuuccgacugagggccucucucccucgcagguuacgauguucccucauauuguggucgacgugcgacagcuggagccagugcuuaucccccugccugauguccguaacaauuuuuaucacuacaaccaaucaaaugacccaaccauaaaguugaucgcuaugcucuauacaccccugagagccaacaacgcgggggaugacguuuucacugugagcugcaggguacugacccggccgaguccugauuuugacuucauuuuucucgugcccccaacagucgaaucccgcaccaaaccuuucucugugcccaucuuaacuguugaggaaaugacaaauagcagauuuccaauuccccuggagaaacuuuucaccggaccuuccucagccuucgugguccagccacagaacgguagguguacgacugauggcguguugcuggggaccacacagcuaaguccgguaaauaucugcacuuuucggggagacguuacccauauaacaggcagccgcaacuacaccaugaaucucgcaucucaaaacugguccaauuaugaucccacggaggaaauuccugcuccacuggguauccccgacuucguggggaagauucagggaaugcuuacucagacaacccgaacugacggcucaacaagaggccacaaggccaccgucuacacggggagcgcugauuuugccccuaagcugggaagggugcaguucgagaccgacacagaucaugacuuugaagcaaaccaaaauacuaaauucaccccagucggugugauccaggauggcaguacaacucaccggaacgagccccagcaauggguuuugccgucuuacuccgggcguaauaccccuaacgugcaccucgccccagcuguagcgcccacauuuccuggagaacagcuguuauucuuucgcagcaccaugcccggcuguucggguuauccaaauauggaccuggauugccuccuuccucaggaguggguccaguacuucuaucaagaggcagcccccgcucagucugacguggcccuguugagauuuguuaacccagauacugggagggugcuauucgaauguaagcugcauaaauccggcuacgucacgguggcacacacaggacagcaugaccucguaaucccgccuaauggcuauuuucgguucgauucaugggugaaccaguucuacacccuggcccccauggggaacggaacuggucgacgcagauga

SEQ ID NO: 21089 - RNA, 1617 nt, Artificial Sequence
  derived and/or modified sequence opt3 from VP1__Norovirus_and/or_Norovirus-like__KP176393
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacuacccacaggaacgagccccaacaguggguauugccgucuuacuccgggcggaauacaccuaacguccaccucgccccagcuguggcgcccaccuuuccuggagaacagcuguuauucuuucguagcacuaugcccggcuguucggguuauccaucuauggaccuggauugccuccuuccucaggaguggguucaauacuucuaucaggaggcagcccccgcucaguccgacguggcccuguugcgcuuugucaauccagauacggggagagugcuauucgaauguaagcugcauaaaucaggcuacguaacaguggcacacaccggacagcaugaccucguuauuccgccuaacggcuauuuuagguucgauaguugggucaaucaauucuacacucuggcccccauggggaacggaaccggucggcgacgcuga

SEQ ID NO: 21090 - RNA, 1617 nt, Artificial Sequence
  derived and/or modified sequence opt3 from VP1__Norovirus_and/or_Norovirus-like__KP096330
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggaccuggauugccuccuuccucaggaguggguucaauacuucuaucaggaggcagcccccgcucagucggacguggcccuguugcgcuuugucaacccagauacgggcagagugcuauucgaauguaagcugcauaaaacaggauacguaaccguggcacacacuggccagcaugaccucguuauuccgccuaauggguauuuuagguucgauucuugggucaaccaauucuacacccuggcccccaugggaaacgguacaggccggcgacgcuga

SEQ ID NO: 21091 - RNA, 1617 nt, Artificial Sequence
  derived and/or modified sequence opt3 from VP1__Norovirus_and/or_Norovirus-like__KM982953
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagaccaaugacccaacaauaaaguugaucgcuaugcucuauacuccccugcgugccaacaacgcgggggaugacguuuucaccgugucaugcagaguacugacaaggccgagcccugauuuugacuucauuuuucucgugcccccaaccgucgaaagucggacuaaaccuuucuccgugcccguuuuaacaguggaggaaaugaccaauucucgcuuuccaaucccccuggagaaacuuuucacgggaccuagcuccgccuucgucgugcagccacagaacgguagauguacuaccgauggcguauugcuggggacaacucaacuaucaccgguuaauauuugcaccuuuaggggagacgugacacauaucaccggcagucggaacuacacgaugaaucucgcaagccagaacuggaauaacuaugaucccacugaggaaauaccugcuccacuggguauucccgacuucgucgggaagauccagggaaugcuuacacagaccacucgcacagacggcucuacccgaggccacaaggccacgguguacaccggguccgucgauuuugcuccuaagcugggaagagugcaauucgagacagacacugaucaugacuuugaagccaaucagaacaccaaauucacaccaguuggugugauucaggauggcucaacuacccacaggaaugagccccaacaguggguauugccgagcuacagugggcggaacacaccuaauguccaccucgcaccagccguggcucccaccuuuccuggagaacagcuguuauucuuucguucuacuaugcccggcuguuccgguuauccaaacauggaccuggauugccuccuuccucaggaguggguucaauacuucuaucaggaggcggcacccgcccagagcgacguggcucuguugcgcuuugucaauccagauacggggagagugcuauucgaauguaagcugcauaaaucgggcuacguaacaguggcccacaccggacagcaugaccucguuaucccgccuaacggcuauuuuagguucgauucuugggucaaccaauucuacacucuggcacccauggggaauggaaccggucggcgacgcuga

SEQ ID NO: 21092 - RNA, 1617 nt, Artificial Sequence
  derived and/or modified sequence opt3 from VP1__Norovirus_and/or_Norovirus-like__KM982936
augaagauggccagcuccgacgcuaaccccucugauggcucagcagccaaucuggugccugaggucaacaaugaaguucucgcgcuugagccagugguaggggcugccaucgcagccccgguggcuggacagcaaaacgucauugaccccuggauaagaaauaacuucgugcaggcaccugguggcgaauuuaccguuaguccaaggaaugcccccggggagauccuguggagcgcuccuuugggaccagauuuaaaccccuaccugucccaccuagcccggauguauaauggcuacgcggguggguucgaagugcaggucauucucgcaggaaacgccuuuacagcuggcaaagugaucuucgccgcaguaccuccaaauuuuccgacugagggccugucucccucgcagguuacgauguucccucauauuguggucgacgugcgccaacuugagccagugcugauccccuugccugauguccgaaacaauuuuuaucacuacaaccagucaaaugacccaaccauaaagcucaucgcuaugcuguauacaccccugcgugccaacaacgcgggggaugacguuuucacugugagcugcagaguacucaccaggccgaguccugauuuugacuucaucuuuuuagugcccccaacagucgaaucccggaccaaaccuuucucugugcccauucugacuguugaggaaaugacaaauagccgcuuuccaauuccccuugagaaguuguucaccggaccuuccucagccuucgugguccagccacagaacgguagauguacgacugauggcgugcugcuagggaccacacaacucaguccgguaaauaucugcacuuuuaggggagacguuacccauauaacaggcagccacaacuacaccaugaaucuggcaucucagaacugguccaauuaugaucccacggaggaaauuccugcuccacuugguacucccgacuucguggggaaaauccagggaguccugacacagaccacucggacagacggcucaacccgcggccauaaggccacgguguacaccgggagcgcugauuuugccccuaaguugggacgaguccaauucgagacagacacugauagagacuuugaagcaaaccagaauaccaaauucacaccaguggguguuauucaggauggcgggacuacccacaggaacgagccccaacagugggugcucccgaguuacucuggacggaauacaccuaacguacaccuggccccagcugucgcgcccaccuuuccuggcgaacaguuacuguucuuucguuccacuaugcccgguuguagcggguauccaaauauggaccucgauugccuucugccucaggagugggugcaauacuucuaucaggaggcagcccccgcucagucggacguugccuugcuacgcuuugugaacccagauacgggcagaguccuguucgaauguaagcuccauaaaucuggauacgugacaguagcacacaccggccagcaugaccuggugaucccgccuaauggguauuuuagguucgauuccuggguuaaccaauucuacacucuugcccccaugggaaacgguaccggccggcgacgcuga

SEQ ID NO: 21093 - RNA, 1617 nt, Artificial Sequence
  derived and/or modified sequence opt3 from VP1__Norovirus_and/or_Norovirus-like__KM514073
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcagguccuacucgcaggaaacgccuuuacagcuggcaaagugauuuucgccgcaguaccuccaaauuuuccgacugagggccugucucccucgcagguuacgauguucccucauaucguggucgacgugcgccaacuugagccagugcugauucccuugccugauguccgaaacaauuuuuaucacuacaaccagucaaaugacccaaccaucaagcucauagcuaugcuguauacaccccugcgugccaacaacgcgggggaugacguuuucacugugagcugcagaguacucaccaggccgaguccugauuuugacuucaucuuuuuagugcccccaacagucgaaucccggaccaaaccuuucucugugcccguucugacuguggaggaaaugacaaauagccgcuuuccaauuccccuugagaaguuguucaccggaccuuccucagccuucgucgugcagccacagaacgguagauguacgacugauggcguacugcuagggaccacacaacucaguccgguuaauaucugcacuuuuaggggagacgugacccauauuacaggcagccggaacuacaccaugaaucuggcaucucagaacugguccaauuaugaucccacggaggaaaucccugcuccacuugguacucccgacuucgucgggaaaauacagggaaugcugacacagaccacucgcacagacggcucaacccgaggccacaaggccacgguguacaccgggagcgcugauuuugccccuaaguugggaagaguccaauucgagacagacacugaucaugacuuugaagcaaaccagaauaccaaauucacaccaguggguguuauucaggauggcaguacuacccacaggaacgagccccaacagugggugcucccgucuuacuccgggcggaauacaccuaacguacaccuggccccagcugucgcgcccaccuuuccuggagaacaguuacuguucuuucguagcacuaugcccggcuguucggguuauccaaauauggaccucgauugccuucugccucaggagugggugcaauacuucuaucaggaggcagcccccgcucagucugacguugccuugcuacgcuuugugaacccagauacggggagaguccuguucgaauguaagcuccauaaauccggcuacgugacaguagcacacaccggacagcaugaccuggugaucccgccuaauggcuauuuuagguucgauucauggguuaaccaauucuacacucuugcccccauggggaacggaaccggucggcgacgcuga

SEQ ID NO: 21094 - RNA, 1617 nt, Artificial Sequence
  derived and/or modified sequence opt3 from VP1__Norovirus_and/or_Norovirus-like__KM268086
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacuggccaggccgaguccugauuuugacuucauuuuucucgugcccccaaccgucgaaucccggacaaaaccuuucucugugcccguuuuaaccguggaggaaaugacuaauagccgcuuuccaaucccccuggagaaacuuuucacaggaccuuccucagcauucgucgugcagccacagaacgguagauguaccacggauggcguauugcuggggacuacccaacuaaguccgguuaauauuugcacauuuaggggagacgugacucauaucaccggcagccggaacuacacaaugaaucucgcuucucagaacugguccaauuaugaucccaccgaggaaauaccugccccacuggguacgcccgacuucgucgggaagauucagggagugcuuacucagacaacccgcacugacggcucaacacgaggccacaaggcuaccgucuacacggggagcgccgauuuugcaccuaagcugggaagagugcaauucgagaccgacacagaucaugacuuugaagccaaccagaauacuaaauucaccccaguuggugugauccaggauggcaguacaacucacaggaacgagccccaacaguggguauugccgucuuacuccgggcggaauaccccuaacguccaccucgcuccagcgguggcacccacauuuccuggagaacagcuguuauucuuucguagcaccaugcccggcuguucggguuauccaaauauggaccuggauugccuccuuccucaggaguggguucaauacuucuaucaggaggccgcucccgcccagucugacguggcacuguugcgcuuugucaacccagauacugggagagugcuauucgaauguaagcugcauaaauccggcuacguaacgguggcccacacaggacagcaugaccucguuauuccgccuaauggcuauuuuagguucgauucaugggucaaccaauucuacacccuggcucccauggggaacggaacuggucggcgacgcuga

SEQ ID NO: 21095 - RNA, 1617 nt, Artificial Sequence
  derived and/or modified sequence opt3 from VP1__Norovirus_and/or_Norovirus-like__KM198552
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuaguauuaacuggaauaacuaugacccgacugaagagauccccgccccucuggggacaccagauuucguaggaaagauccagggcguucuuacccagacuacaaagggcgacgggagcacccgcggacacaaggcuacgguguacaccgguucugcccccuuuacaccuaaacugggcuccguccaguucucaacugacaccgaaaaugauuuugagacacaucaaaacacuaaguucaccccagugggggucauucaggacggaggcacaacccaccgaaaugaaccccagcaauggguguugccgagcuacagugguagagauguucacaacgugcaucucgccccugcaguagcuccaacuuuucccggggagcagcuguuauucuuuaggucuacgaugccuggcuguuccggauaucccaauauggaccuggauugccuccuuccacaggaguggguccagcacuucuaccaagaagcggccccugcacagagcgacgcugcccuguugcgguuugugaaccccgauacaggccguguucuauucgaguguaaacugcauaagucgggguaugugaccgucgcacacacuggacagcacgaccucgugauaccaccgaaugguuacuuucgcuucgauucuuggguaaaccaguucuauacccuggccccuaugggcaacgggacaggaagaaggcgguga

SEQ ID NO: 21096 - RNA, 1617 nt, Artificial Sequence
  derived and/or modified sequence opt3 from VP1__Norovirus_and/or_Norovirus-like__KJ716358
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagcagugacccauaucacaggcagccggaacuacaccaugaaucucgcuucucagaacugguccaauuaugaccccacggaggaaauaccugccccacuggguacucccgauuucgucgggaagauucagggagugcuuacacagaccacucgcacagacggcucaacccgaggccacaaggcuacggucuacaccgggagcgccgacuuugcaccuaagcugggaagagugcaauucgagacagauacugacagggauuuugaagccaaccagaauaccaaauucacaccaguuggugugauccaggacggcaguacuacccaucggaacgagccccaacaguggguauugccgucuuacuccgggcguaauacaccuaacguccaccucgcuccagcgguggcacccaccuuuccuggagaacagcuguuauucuuucgcagcauuaugcccggcuguucggguuauccaaauauggaucuggacugccuccuuccucaggaguggguucaauacuucuaucaggaggccgcucccgcccagucugauguggcacuguugagauuugucaacccagacacugggagggugcuauucgaauguaagcugcacaaauccggcuacguaacgguggcccauacaggacagcacgaucucguuaucccgccuaauggcuauuuucgguucgacucaugggucaaccaauucuacacccuggcucccauggggaacggaacuggucgacgcagauga

SEQ ID NO: 21097 - RNA, 1617 nt, Artificial Sequence
  derived and/or modified sequence opt3 from VP1__Norovirus_and/or_Norovirus-like__KJ649702
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggaaugcuuacacagaccacucgcacagacggcucaacccgaggccacaaggccacgguguacaccgggagcgcugauuuugccccuaagcugggaagaguccaauucgagacagacacugauagggacuuugaagcaaaccagaauaccaaauucacaccaguggguguuauccaggauggcaguacuacccaucggaacgagccccaacaguggguguugccgucuuacuccgggcguaauacaccuaacguacaccucgccccagcugucgcgcccaccuuuccuggagaacagcuguuauucuuucgcagcacuaugcccggcuguucggguuauccaaauauggaccuggauugccuccuuccucaggagugggugcaauacuucuaucaggaggcagcccccgcucagucugacguugcccuguugagauuugugaacccagauacggggaggguccuauucgaauguaagcugcacaaauccggcuacgugacaguagcacauaccggacagcacgaccucgugauuccgccuaauggcuauuuucgguucgauucauggguuaaccaauucuacacucuggcccccauggggaacggaaccggucgacgcagauga

SEQ ID NO: 21098 - RNA, 1617 nt, Artificial Sequence
  derived and/or modified sequence opt3 from VP1__Norovirus_and/or_Norovirus-like__KF429778
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauugccggcagccggaacuacaccaugaaucucgcaucucagaacuggaacuccuaugaucccacggaggaaaucccugcuccacuggguacucccgacuucguugggaagauucagggagugcuuacacagaccacucgcacagacggcucaacccgaggccacaaggccacggucuacaccgggagcgcugauuuuaguccuaagcugggaagagugcaauucgccacagacacugauaaugacuuugucaccaaucagaacacaaaauucacuccaguggguguuauccaggauggcgggaccacacccaggaaugagccgcaacaguggguguugccuucuuacuccggacggaacacccauaauguacaccucgcaccagccgucgcucccacuuuuccuggcgaacagcuguuauucuuucguagcacgaugcccgguuguucgggguauccaaacauggaccuggauugccuccuuccucaggagugggugcaauacuucuaucaggaagcggcacccgcccagucugacguugcucuguugcgcuuugugaauccagauacaggcagaguccuauucgaguguaagcugcacaaauccggauacgugaccguagcccauacuggccagcacgaccucgugaucccgccuaacggguauuuuagguucgauucauggguuaaccaauucuacacccuggcacccaugggaaaugguacaggccggcgacgcuga

SEQ ID NO: 21099 - RNA, 1617 nt, Artificial Sequence
  derived and/or modified sequence opt3 from VP1__Norovirus_and/or_Norovirus-like__KF060113
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccgggccaaaccuuucucugugcccguuuuaaccguggaggaaaugacuaauagccgcuuuccaaucccccuggagaaacuuuucacaggaccuuccucagcauucgucgugcagccacagaacgguagauguaccacggauggcguauugcuggggacuacccaacuaaguccgguuaauauuugcacauuuaggggagacgugacucauaucaccggcagccggaacuacacaaugaaucucgcuucucagaacugguccaauuaugaucccaccgaggaaauaccugccccacuggguacgcccgacuucgucgggaagauucagggagugcuuacucagacaacccgcacugacggcucaacacgaggccacaaggcuaccgucuacacggggagcgccgauuuugcaccuaagcugggaagagugcaauucgagaccgacacagaucaugacuuugaagccaaccagaauacuaaauucaccccaguuggugugauccaggauggcaguacaacucacaggaacgagccccaacaguggguauugccgucuuacuccgggcggaauaccccuaacguccaccucgcuccagcgguggcacccacauuuccuggagaacagcuguuauucuuucguagcaccaugcccggcuguucggguuauccaaauauggaccuggauugccuccuuccucaggaguggguucaauacuucuaucaggaggccgcucccgcccagucugacguggcacuguugcgcuuugucaacccagauacugggagagugcuauucgaauguaagcugcauaaauccggcuacguaacgguggcccacacaggacagcaugaccucguuauuccgccuaauggcuauuuuagguucgauucaugggucaaccaauucuacacccuggcucccauggggaacggaacuggucggcgacgcuga

SEQ ID NO: 21100 - RNA, 1617 nt, Artificial Sequence
  derived and/or modified sequence opt3 from VP1__Norovirus_and/or_Norovirus-like__KF060106
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucgugcuagcgggaaacgcauuuacugccggcaaaauuaucuucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccguguuaacaguugaggaaaugaccaauagccgcuuuccaauuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauaagcggcucucggaacuacaccaugaaucucgccucccagaacuggaacucauaugaucccacggaggaaauuccugcaccacuggguacucccgacuucguggggaagauccagggaguccuuacacagaccacucgcacagacggcagcacccgaggccacaaggcuacgguguacaccgggagugccgauuuuucuccuaagcugggaagaguccaauucgcuacagacacugauaaugacuuugugaccaaucagaacacaaaauucacuccaguuggugugauucaggauggcuccaccacacccaggaaugagccgcaacaguggguauugccuagcuacucggggcggaacacccauaauguccaccucgccccagcaguggcccccacuuuuccuggagaacagcuguuauucuuucguucuacgaugcccggcuguuccgguuauccaaacauggaccuggauugccuccuuccucaggaguggguucaauacuucuaucaggaagcugcgcccgcacagucagacguggcccuguugcgcuuugucaauccagauacagggagagugcuauucgaguguaagcugcacaaaaguggcuacguaaccguggcucauacuggacagcacgaccucguuaucccgccuaacggcuauuuuagguucgauagcugggucaaccaauucuacacccuggcccccauggggaauggaacaggucggcgacgcuga

SEQ ID NO: 21101 - RNA, 1617 nt, Artificial Sequence
  derived and/or modified sequence opt3 from VP1__Norovirus_and/or_Norovirus-like__KF060100
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucacaacuacaccaugaaucucgccucccagaacuggaacucauaugaucccacggaggaaaucccugcaccacuggguacucccgacuucguugggaagauucagggaaugcuuacacagaccacucggacagacggcagcacccgcggccauaaggcuacgguguacaccgggagugucgauuuuucuccuaagcugggacgagugcaauucacaacugacaccgauaaugacuuugagacaaaucagaacacuaaauucaccccagucggugugauccaggauggcuccacaacccacagaaaugaaccccaacaguggguuuugccgagcuacucggggaggaacacucacaaugugcaucucgccccugcuguagccccaacguuucccggagagcagcuguuauucuuucggucuacaaugccuggcuguuccgguuaucccaacauggaccuggauugccuccuuccacaggaauggguccaauacuucuaucaggaggcagccccugcucagucagacguggcgcuguugcguuuuguuaaucccgauaccgggcgcgugcuauucgaguguaagcugcacaaaaguggcuacgucacuguggcacauaccggacagcacgaccucguaaucccaccgaacggcuauuuuagauucgauagcugggugaaccaauucuacacacuggccccuauggggaauggaaccgguaggcggcgauga

SEQ ID NO: 21102 - RNA, 1617 nt, Artificial Sequence
  derived and/or modified sequence opt3 from VP1__Norovirus_and/or_Norovirus-like__KF060069
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucacaacuacaccaugaaucucgccucccagaacuggaacucauaugaucccacggaggaaaucccugcaccacuggguacucccgacuucguugggaagauucagggagugcuuacacagaccacucggacagacggcagcacccgcggccauaaggcuacggucuacaccgggagugccgauuuuucuccuaagcugggacgagugcaauucgcuacagacacugauaaugacuuugucaccaaucagaacacaaaauucacuccaguggguguuauccaggauggcuccaccacacccagaaaugagccgcaacaguggguguugccuagcuacucggggaggaacacccacaauguacaccucgccccagcagucgcccccacuuuuccuggagaacagcuguuauucuuucggucuacgaugcccggcuguuccgguuauccaaacauggaccuggauugccuccuuccucaggagugggugcaauacuucuaucaggaagcugcgcccgcacagucagacguugcccuguugcguuuugugaauccagauacagggcgcguccuauucgaguguaagcugcauaaaaguggcuacgugaccguagcucacacuggacagcaugaccucgugaucccgccuaacggcuauuuuagauucgauagcuggguuaaccaauucuacacccuggcccccauggggaauggaacagguaggcggcgauga

SEQ ID NO: 21103 - RNA, 1617 nt, Artificial Sequence
  derived and/or modified sequence opt3 from VP1__Norovirus_and/or_Norovirus-like__KF060055
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucauaugacccaacaauuaaguugaucgcaaugcucuacacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacauauucccggcagccacaauuauaccaugaaccucgccucucagaauuggaacuccuacgauccuacggaggaaaucccagcaccccuggguacuccugacuucguugggaagauucagggagugcuuacacagaccacuaagacaaauggcucaacccggggccauaaggcuacggucuacaccgggagcgccgacuuuaguccaaaacugggacgcgugcaauucgcuacagauacuaacaaugacuuugagaccaaccagaauacaaaguucacucccgucggugugauccaggauggcucuaccacaccgcgaaacgaaccucaacaguggguuuugccauccuauagcgggagaaauauccacaacgugcaccucgcccccgcaguagccccuaccuuucccggagagcagcuguuauucuuuaggucgacuaugccaggcuguucugguuacccuaauauggaccuggauugccuccuuccccaggaauggguccaauauuucuaccaggaggcugcgccagcacaguccgacguggcccuguugcgguuuguuaacccggauacggggcgugugcuauucgaguguaaacugcauaagucaggcuaugucacaguggcuuacaccggacagcacgaccucguaauuccucccaacggcuauuuucgcuucgauaguugggugaaucaauucuacacucuggccccaauggggaacggaaccgguagaaggcgguga

SEQ ID NO: 21104 - RNA, 1617 nt, Artificial Sequence
  derived and/or modified sequence opt3 from VP1__Norovirus_and/or_Norovirus-like__KF060028
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucauaguugacgugcgccaacuggagccaguccuuaucccccugccugaugugcgaaauaacuuuuaucauuacaaucagucaaacgacccaacaauuaaguugaucgcaaugcucuauacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacacauuagcggcucucggaauuacaccaugaaccucgccucccagaauuggaacucauaugaucccacggaggaaaucccugcaccacuggguacucccgacuucguugggaagauucagggagugcuuacacagaccacucgcgcugacggcagcacacgaggccauaaggccaccgucuacacggggagugcugauuuuucuccuaagcugggaagagugcaauucgccaccgacacagauaaugacuuugucgcaaaccagaauacuaaauucaccccaguggguguuauccaggauggcuccacaacucccaggaacgagccgcaacaguggguguugccuagcuacucggggcggaauacccacaacguacaccucgccccagcugucgcgcccacauuuccuggagaacagcuguuauucuuucguucuaccaugcccggcuguuccgguuauccaaauauggaccuggauugccuccuuccucaggagugggugcaauacuucuaucaggaagcagcccccgcucagucagacguugcccuguugcgcuuugugaacccagauacugggagaguccuauucgaguguaagcugcauaaaaguggcuacgugacgguagcacacacaggacagcaugaccucgugaucccgccuaauggcuauuuuagguucgauagcuggguuaaccaauucuacacccuggcccccauggggaacggaacuggucggcgacgcuga

SEQ ID NO: 21105 - RNA, 1617 nt, Artificial Sequence
  derived and/or modified sequence opt3 from VP1__Norovirus_and/or_Norovirus-like__KF060022
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcgccuuuaggggagacguaacccauauuagcggcucucggaacuacacaaugaaucucgcaucccagaacuggaacucauaugaucccaccgaggaaaucccugcuccacuggguacgcccgacuucguugggaagauucagggaaugcuuacucagacaacccgcacugacggcagcacacgaggccacaaggccaccguguacacggggagugcugauuuuucuccuaagcugggaagaguccaauucgccaccgacacagauaaugacuuugugacuaaucagaacaccaaauucacaccagucggugugauccaggauggcuccacuacccccaggaaugagccgcaacaguggguuuugccuagcuacucggggcggaacacacauaaugugcaccucgcaccagccguagcucccaccuuuccuggagaacagcuguuauucuuucguucuacuaugcccggcuguuccgguuauccaaacauggaccuggauugccuccuuccucaggaguggguccaauacuucuaucaggaagcggcacccgcccagucagacguggcucuguugcgcuuuguuaauccagauacggggagagugcuauucgaguguaagcugcacaaaaguggcuacgucacaguggcccauaccggacagcacgaccucguaaucccgccuaacggcuauuuuagguucgauagcugggugaaccaauucuacacucuggcacccauggggaauggaaccggucggcgacgcuga

SEQ ID NO: 21106 - RNA, 1617 nt, Artificial Sequence
  derived and/or modified sequence opt3 from VP1__Norovirus_and/or_Norovirus-like__KC517376
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuccaccggaccuucaagugccuucgucgugcagccacagaacgguagauguacgacugauggcguauugcuggggaccacacaacuaagcccgguuaauauuugcacuuucaggggagacgugacccauaucacaggcucucggaacuacaccaugaaucucgcaucccagaacuggaauaacuaugaucccacggaggaaauaccugcuccacuggguacucccgacuuugucgggaagauucagggagugcuuacacagaccacucgcacagacggcucaacccgaggccacaaggccacggucuacaccgggagcgcugauuucgccccuaagcugggaagagugcaauuugagacagacacugaucaugacuucgaagcaaaucagaacaccaaauuuacaccaguuggugugauccaggauggcgggacuacccacaggaaugagccccaacaguggguauugccgaguuacucuggacggaacacacacaauguccaucucgccccugcuguggcgccaaccuuccccggcgaacagcuguuauuuuuccguuccacuaugccugguuguagcggguaucccaacauggaccuggauugccuccuuccacaggaguggguucaauacuuuuaucaggaggcagccccugcucagucggacguggcccuguugcgcuucgucaaucccgauacgggcagagugcuauuugaauguaagcugcacaaaucuggauacguaacaguggcacauaccggccagcacgaccucguuauuccaccgaacggguauuucagguuugauuccugggucaaccaauucuacacucuggccccuaugggaaaugguaccggccggcgacgcuga

SEQ ID NO: 21107 - RNA, 1617 nt, Artificial Sequence
  derived and/or modified sequence opt3 from VP1__Norovirus_and/or_Norovirus-like__KC517374
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaacuccugcuccacuggguacacccgacuucgucgggaagauacagggagugcuuacccagacuacacgcaccgacggcuccacgcgaggccacaaggccaccgucuacacagggucagcugauuuugccccuaagcugggaagagugcaauucgagacugacaccgaucaugacuuugaagcaaaucagaacacaaaauucacuccaguuggugugauucaggauggcgggaccacacacaggaaugagccccaacaguggguauugccgagcuacaguggacggaacacccacaauguccaucucgccccugcuguggcgccaacuuuucccggcgaacagcuguuauucuuucguucuacgaugccugguuguuccggguaucccaacauggaccuggauugccuccuuccacaggaguggguucaauacuucuaucaggaggcagccccugcucacagcgacguggcccuguugcgcuuugucaaucccgauacaggcagagugcuauucgaauguaagcugcauaaaucgggauacguaaccguggcacacacuggccagcacgaccucguuaucccaccgaacggguauuuuagguucgauucuugggucaaccaguucuacacccuggccccuaugggauccgguacaggccggcgacgcuga

SEQ ID NO: 21108 - RNA, 1617 nt, Artificial Sequence
  derived and/or modified sequence opt3 from VP1__Norovirus_and/or_Norovirus-like__KC409308
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaauggaugcucccgagcuacagugguagagaugugcacaacguucaucuggccccugcaguggcuccaacuuuucccggggagcaguuacuguucuuuaggucuacgaugccuggcuguuccggauaucccaauauggaccucgauugccuucugccacaggaguggguacagcacuucuaccaagaagcggccccugcacagagcgacgucgcuuugcuacgguuugugaaccccgauacaggccguguucuguucgaguguaaacuccauaagucgggguaugugaccgucgcccacacuggacagcacgaccuggugauuccaccgaaugguuacuuucgcuucgauucuuggguaaaccaguucuauacccuugcaccuaugggcaacgggacaggaagaaggcgguga

SEQ ID NO: 21109 - RNA, 1617 nt, Artificial Sequence
  derived and/or modified sequence opt3 from VP1__Norovirus_and/or_Norovirus-like__KC175393
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcgcgucauucuagcaggaaacgccuuuacagcuggcaaaaucauuuucgccgcagugccuccaaauuuuccgacugagggccucucucccucgcagguaacgauguucccucauaucauaguugacgugcgacagcuggagccaguccuuaucccccugccugaugugcguaacaauuuuuaucacuacaaccaaaccaaugacucaacaauuaaguugaucgcuaugcucuauacuccacugagagccaacaacgcgggggaagauguguucaccgucagcugcaggguucugacacggcccaguccggacuuugauuucauuuuucucgugccucccaccguagagucccgcacuaaaccauucacagugccuaucuuaaccgucgaagagaugacuaauucuagauuucccauaccacuggagaaacuuuucacgggacccagcggugccuucgugguucagccucagaacgggagguguaccacagacggcguguugcugggaacuacccagcuauccccagucucaauuugcacauuucggggcgaugugacccauaucgcagguagucgcaauuacacgaugaaccucgcuagccugaauuggaacaauuaugacccgacugaagagauucccgccccucuugggacaccagauuucguaggaaagauccaaggcguucugacccagacuacaaagggcgacgggucuacccgaggacacaaggcuacgguguacaccgguuccgcccccuuuacaccuaaauugggcucaguccaguucagcacugacaccgaaaacgauuuugagacacaucagaauacuaaguucaccccagugggggucauccaagacggaggcacaacccacagaaacgaaccccagcagugggugcucccgaguuacucugguagggauguucacaaugugcaucuggccccugcaguagcuccaacuuuucccggggagcaauuacuguucuuucgguccacgaugccuggcuguagcggauaucccaacauggaccucgauugccuucugccacaggaguggguccagcacuucuaccaggaagcggccccugcacaaucggacguggcuuugcuacguuuuguuaaucccgauacaggccgcgugcuguucgaguguaaacuccauaagucuggguaugucaccguggcccacacuggacagcacgaccugguaauuccaccgaacgguuacuuuagauucgauuccugggugaaucaguucuauacccuugcaccuaugggcaacgggacaggaaggcggcgauga

SEQ ID NO: 21110 - RNA, 1617 nt, Artificial Sequence
  derived and/or modified sequence opt3 from VP1__Norovirus_and/or_Norovirus-like__JX459623
augaagauggccagcaacgaccccaauccuuccgauggcucugcugcaaaccuggugccagaggucaauaacgaaguuauggcccucgagccggugguaggggcggcuaucgccgcacccguggccggacagcaaaaugucauugacccuuggauaagaaacaauuucgugcaggcuccagguggcgaauuuaccguuucacccaggaacgcaccuggggagauccuuuggagugccccacugggacccgauuugaauccuuacuuaagccaccuggcucggauguauaacggcuacgccgguggguucgaagugcaggucauucuagcgggaaaugcauuuacagccggcaaaaucauuuucgcugccgugccaccgaacuuucccacugagggccucuccccuucucagguaacgauguucccacauaucauaguugacgugcgccaacuggagcccguccuuaucccucugccagaugugcgaaauaacuuuuaucacuacaaucagucgaacgacucaaccauuaaguugaucgcaaugcucuauacaccccugcgugcuaacaaugccggggaagauguguucacugucagcugcagaguucugaccaggccgaguccugacuuugauuucauuuuucucgugcccccaacaguagagucccggaccaaaccuuucacugugcccaucuuaacagucgaagagaugaccaacucucgcuuuccaauaccccuggagaaacuuuucacgggaccuagcggugcguucgugguucagccacagaauggcagauguacuaccgacgggguguugcugggaacaacucaacuauccccggucaacauuugcaccuuuaggggcgaugugacacauaucgccgguacccggaauuacacgaugaaccucgcaucacugaauuggaacaauuaugaccccacugaagagauuccugcuccacuugggacacccgauuucguaggaaagauccagggcguucugacccagacuacaaagggcgacgggaguacccgcggacacaaggccacgguguacaccgguagcgcuccuuuuacaccaaaauugggcucuguccaguucuccacugacaccgaaaacgauuuugagacacaucaaaauacuaaguucacccccgugggggucauccaggacggaggcacaacccaccgaaacgaaccgcagcaaugggugcucccuucauacagcgguagaaauguucacaacgugcaucuggccccagcaguagcccccacuuuuccuggggagcaguuacuguucuuuaggaguacgaugcccggcuguucuggauauccaaauauggaucucgacugccuucugccucaggaguggguccagcacuucuaccaagaagcugcgcccgcacaguccgauguggccuugaugcgguuuguuaacccagacacaggccgugugcuauucgaguguaaacugcauaagagcggguaugucaccguggcucacacuggacagcacgaucucguaauuccgccuaacgguuacuuucgcuucgacucgugggugaaucaguucuauacccuggcccccaugggcaacgggacaggaagaaggcgguga

SEQ ID NO: 21111 - RNA, 1617 nt, Artificial Sequence
  derived and/or modified sequence opt3 from VP1__Norovirus_and/or_Norovirus-like__JQ798158
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuagcucaccuggcccggauguauaacggcuacgcggguggguucgaagugcaggucauucuagcaggaaaugccuuuacugcuggcaaaaucauuuucgccgcagugccuccaaacuuuccgacggagggccucagccccucccagguaaccauguucccucauaucguuguggacguccgccaacuggagccagugcuuauaccccugccugauguggggaauaacuuuuaucacuacaaucagucuaacgacccaacaaucaaguugauugcuaugcucuauacuccccugcgagccaacaaugcgggagaagaugucuucaccguuucgugccgugugcugacaagaccgucaccugacuuugauuucaucuuucucguacccccaaccguggagagcaggacuaaaccuuucacaguccccauuuuaaccguggaagagaugacgaacagucgguuuccaaucccccuggagaaacuuuucacugguccuuccggcgccuucguugugcagccacagaaugggcgcuguaccacagacggagucuugcugggcacuacccaacuaucuccggugaacauaugcacauuuagaggugauguaacccauauugcagggacgcacaauuacacuaugaaccucgcuagccagaauuggaacaauuaugaccccacagaagagaucccugccccacugggaacccccgauuucguuggcaggauucagggcaugcuuacucagacaacccgcggggacggauccacgcggggucauaaggcuaccgugucaacaggcgacguccacuuuacuccuaagcuggggaguauccaauucaacaccgauacaaauaacgacuuugaaacuggacagaauaccaaguucacaccagugggcgucgugcaggaugguaacggggcccaccaaaaugagccccagcaguggguuuugccgagcuacucuggccgaaccggacauaacgugcaccucgccccugcaguagcuccaacuuuucccggcgaacagcuguuauucuuuagauccacgaugccuggguguucaggauaccccaacaugaaucuggacugccuccuuccacaagaguggguccagcauuucuaucaggaggcggccccugcacagagcgauguggcucuguugagguuuguuaaccccgacacaggucgggugcuauucgaauguaaacugcacaagaguggcuacgucaccguggcccacacugggcaacaugaucucguaaucccaccgaauggauauuuucguuucgacucuugggugaaccaguucuacacccuggcaccuaugggcaaugguacagggcgcagaagguga

SEQ ID NO: 21112 - RNA, 1617 nt, Artificial Sequence
  derived and/or modified sequence opt3 from VP1__Norovirus_and/or_Norovirus-like__JQ613566
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaguuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauacccggcagccggaacuacaccaugaaucucgccucucagaacuggaacuccuaugauccuacggaggaaauuccagcaccccuggguacuccugacuucguggggaagauccagggaguccuuacacagaccacucgcacaaauggcucaacccgaggccacaaggcuacgguguacaccgggagcgccgacuuuaguccaaagcugggaagaguccaauucgcuacagauacugacaaugauuuugagaccaaccagaauacaaaauucacucccguggguguuauucaggacggcucuaccacaccgaggaacgaaccucaacaguggguguugccauccuacagcgggcggaauauccauaacguacaccucgcccccgcagucgccccuaccuuucccggagagcagcuguuauucuuucguucgacuaugccaggcuguucugguuauccuaauauggaucuggacugccuccuuccccaggaaugggugcaauacuucuaucaggaggcugcgccagcacaguccgauguugcccuguugcgcuuugugaacccggacacggggagaguccuauucgaguguaagcugcacaaaucaggcuacgugacaguagcucauaccggacagcacgaucucgugaucccucccaacggcuauuuuagguucgacaguuggguuaaucaauucuacacucuggccccaauggggaacggaaccggucggcgacgcuga

SEQ ID NO: 21113 - RNA, 1617 nt, Artificial Sequence
  derived and/or modified sequence opt3 from VP1__Norovirus_and/or_Norovirus-like__AB541287
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucgugcuagcaggaaaugccuuuacagcuggcaaaguaauuuucgccgcaguuccuccaaacuuuccgacugagggccucucccccucucaggugacgauguucccucauaucauugucgacgugcgccaacuggagccagugcuuaucccccugccugauguccgaaauaacuuuuaucacuacaaucagucgaacgacucaaccauaaaguugaucgcuaugcucuauacaccacugcgugccaacaaugcgggggaagauguuuucacugugagcugcagaguacugaccaggcccaguccggacuuugauuucauuuuucucgugccucccacagucgagucccggaccaaaccauucacugugccuaucuuaacaguugaagagaugaccaacucucgcuuucccauuccacuggagaaacuuuucacgggacccagcggugccuucgugguccagccucagaauggcagauguacuaccgacgggguguugcugggaacaacucaacuauccccaguaaacaucugcaccuuuaggggcgauguuacacauauagcagguucacggaauuacaccaugaaccucgcuagucugaauuggaacaauuaugacccgacggaagagauucccgccccucuugggacuccagauuucgugggaaagauccagggcguccugacacagaccacuaagggcgacgggagcacacgcggacacaaggcuaccguguacacggguucuacccccuuuacaccuaaauugggcuccguccaguucucaacugacaccgaaaacgauuuugagaaucaucaaaacacaaaguucacuccaguggggguuauucaggacggaggcaccacacaccgaaaugaaccccagcaaugggugcucccgagcuacagugguagaaacguacagaauguccaccuggccccugcaguggccccaaccuuucccggggagcaguuacuguucuuuaggucuacuaugccuggcuguuccggauaucccaacauggaucucgacugccuucugccacaggaguggguucaacauuucuaccaggaagcugcgccugcacagagcgauguggccuugcuacgguuugucaaccccgacacgggccgugugcuguucgaguguaaacuccacaagucgggguauguaacaguggcucauaccggacagcacgaucugguuaucccaccgaaugguuacuuucgcuucgacucuugggucaaccaauucuauacucuugccccuaugggcaaugggaccggaagaaggcgguga

SEQ ID NO: 21114 - RNA, 1617 nt, Artificial Sequence
  derived and/or modified sequence opt3 from VP1__Norovirus_and/or_Norovirus-like__AB504320
augaagauggccagcaacgacgcuaaucccuccgauggcucugcagccaaccuggugccugaggucaauaacgaaguuauggcgcucgagccaguggcuggggccgcaaucgccgcuccgguagcaggacagcaaaaugugauugaccccuggauaagaaacaauuucguccaggccccugguggcgaauuuaccgugucaccaaggaacgcucccggggagauccuuuggagugccccucugggaccagauuugaaucccuacuuaagccaccuggcgcggauguauaacggcuacgccgguggguucgaaguucaggugauucuagcaggaaaugcuuuuacagccggcaaaaucauuuucgcagcugucccuccaaacuuuccgacugagggccucucccccucucaggugacgauguucccucauaucauaguagacguucgccaacuggagccagugcuuaucccccugccugauguccgaaauaacuuuuaucacuacaaucagucgaacgacucaaccauuaaguugaucgccaugcucuauacaccacugcgugcgaacaaugccggggaagauguguucacugugagcugcagaguccugaccaggcccaguccggacuuugauuucauuuuucucguuccucccacaguggagucccggaccaaaccauucacuguaccuaucuuaacaguggaagagaugaccaacucucgcuuucccauaccacuggagaaacuuuucacgggacccagcggugcauucgucgugcagccucagaauggcagauguacuaccgacgggguuuugcugggaacaacucaacuauccccagugaacauuugcaccuuuaggggcgaugucacacauaucgcugguacccggaauuacacgaugaaccucgccucacugaauuggaacaauuaugacccgacugaagagauucccgcuccucuugggacaccagauuucgugggaaagauccagggcguacugacccagacuacaaagggcgacgggaguacccgcggacacaaggccacgguuuacaccgguagcgcacccuuuacaccuaaauugggcucugugcaguucuccacugacaccgaaaacgauuuugagacacaucaaaauacuaaguucaccccagucggggugauccaggacggaggcacaacccaccgaaacgaaccccagcaauggguccucccgucauacagcgguagaaaugugcacaacguucaucuggccccugcuguggcgccaacuuuucccggggagcaguuacuguucuuuaggaguacgaugccuggcuguucuggauaucccaauauggaucucgacugccuucugccacaggaguggguacagcacuucuaccaagaagcagccccugcucaguccgaugucgccuugaugcgguuugugaaccccgacacaggccguguucuauucgaguguaaacugcauaagagcggguaugugaccgucgcacacacuggacagcacgaucucgugauuccaccgaacgguuacuuucgcuucgacucguggguaaaucaguucuauacccuggccccuaugggcaacgggacaggaagaaggcgguga

SEQ ID NO: 21115 - RNA, 1617 nt, Artificial Sequence
  derived and/or modified sequence opt3 from VP1__Norovirus_and/or_Norovirus-like__KU683739
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggaaugcuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauccaggauggcaguacuacccacaggaacgagccccaacaguggguguugccgucuuacuccgggcggaauacaccuaacguacaccucgccccagcugucgcgcccaccuuuccuggagaacagcuguuauucuuucguagcacuaugcccggcuguucggguuauccaaauauggaccuggauugccuccuuccucaggagugggugcaauacuucuaucaggaggcagcccccgcucagucugacguugcccuguugcgcuuugugaacccagauacggggagaguccuauucgaauguaagcugcauaaauccggcuacgugacaguagcacacaccggacagcaugaccucgugauuccgccuaauggcuauuuuagguucgauucauggguuaaccaauucuacacucuggcccccauggggaacggaaccggucggcgacgcuga

SEQ ID NO: 21116 - RNA, 1617 nt, Artificial Sequence
  derived and/or modified sequence opt3 from VP1__Norovirus_and/or_Norovirus-like__KX354146
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccgucuuaacuguggaggaaaugacaaauagccgccugccaaucccccuugagaaguuguuuaccggaccuuccucagccuucguugugcagccacagaacgguagauguacgacugauggcguccugcuagggaccacacaacucaguccggugaauauaugcacuuucaggggagacguaacccauauuacaggcagccggaacuacaccaugaaucuggcaucucagaacuggaauaacuaugaucccacggaggaaaucccugcuccacuugguacucccgacuuuguugggaaaauucagggaaugcugacacagaccacucgcacagacggcuccacccgaggccacaaggccacgguguacaccgggucagcugauuucgccccuaaguugggaagaguccaauuugagacagacacugaucaugacuucgaagcaaaucagaacaccaaauuuacaccagugggugucauccaggauggcagcacuacccacaggaaugagccccaacagugggugcucccgaguuacucugggcggaacacacacaauguucaucuggccccugcuguggcgccaaccuuccccggagaacaguuacuguuuuuccguuccacuaugccuggcuguagcgguuaucccaacauggaccucgauugccuucugccacaggaguggguacaauacuuuuaucaggaggcagccccugcucagucggacgucgccuugcuacgcuucgugaaucccgauacggggagaguucuguuugaauguaagcuccacaaaucuggcuacgugacagucgcacauaccggacagcacgaccuggugaucccaccgaacggcuauuucagguuugauuccuggguaaaccaauucuacacucuugccccuauggggaauggaaccggucggcgacgcuga

SEQ ID NO: 21117 - RNA, 1617 nt, Artificial Sequence
  derived and/or modified sequence opt3 from VP1__Norovirus_and/or_Norovirus-like__KX354075
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucaccaaucagaacacaaaauucacuccaguggguguuauccaggauggcuccaccacacccaggaaugagccgcaacaguggguguugccuagcuacucggggcggaacgcccauaauguacaccucgcaccagccgucgcucccaccuuuccuggagaacagcuguuauucuuucguucuacuaugcccggcuguuccgguuauccaaacauggaccuggauugccuccuuccucaggagugggugcaauacuucuaucaggaagcggcacccgcccagucagacguugcucuguugcgcuuugugaauccagauacggggagaguccuauucgaguguaagcugcacaaaaguggcuacgugacaguagcccauaccggacagcacgaccucgugaucccgccuaacggcuauuuuagguucgauagcuggguuaaccaauucuacacucuggcacccauggggaauggaaccggucggcgacgcuga

SEQ ID NO: 21118 - RNA, 1617 nt, Artificial Sequence
  derived and/or modified sequence opt3 from VP1__Norovirus_and/or_Norovirus-like__KX354072
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaaaggcuacgcggguggguucgaagugcaggucauucuagcaggaaacgccuuuacagcuggcaagaucauuuucgccgcagugccuccaaauuuuccgacugagggccucucccccucucagguaacgauguucccucauaucauaguugacgugcgccaacuggagccaguccuuaucccccugccugaugugcgaaacaauuuuuaucacuacaaccagucgaaugacucaaccauuaaauugaucgcuaugcucuauacaccaccccgugccaacaacgcgggggaugacguguucacugucagcugcagaguucugaccaggccgaguccugauuuugacuucauuuuucuggugcccccaacaguagaaucccggaccaagccuuucacugugcccauccucacagucgaggaaaugaccaauucucgcuuuccaauacccuuagagaaacuguucacgggaccuagcuccgccuucgugguucagccacagaacgguagauguacuaccgauggcgugcuuuuggggacaacucaacugucaccggucaauauuugcaccuuuaggggagacgugacacauaucgcaggcagucggaacuacaccaugaaucuagcuagccucaacuggaauaacuaugaucccacggaggaaauuccugccccacuggguacucccgacuucguagggaagauccagggaguucuuacacagaccacuaagggcgacggcucuacacgcgggcacaaagcuaccguguacacgggauccgccgauuuuaccccuaagcuggguucaguccaguucgcaacagacacugagaaugauuuugaaacccaucaaaacacacgauucacuccagugggcgucauccaggacgggagcaccacacacagaaaugagccccagcaauggguguugccgaguuacucuggaaggaacguucacaaugugcaucucgccccugcuguagcgccaaacuuucccggcgaacagcuguuauucuuucgguccaccaugccugguuguagcggguaucccaauauggaucuggacugccuccuuccacaggaguggguccagcacuucuaccaagaggcagccccugcucagucggauguggcccuguugcguuuuguuaaccccgacacuggccgcgugcuauucgaauguaaacugcauaagucuggauaugucacgguggcacacacaggccagcacgaucucguaauuccaccgaacggguacuuuagauucgacuccugggugaaucaguucuauacccuggccccuaugggaaacgguacuggcaggcggcgauga

SEQ ID NO: 21119 - RNA, 1617 nt, Artificial Sequence
  derived and/or modified sequence opt3 from VP1__Norovirus_and/or_Norovirus-like__KX354060
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaauuccugcaccacuggguacucccgacuucguagggaagauccagggaguucuuacacagaccacuagcacaaauggcaguacccggggccauaaggcuacgguguacaccgggucugccgacuuuuccccuaagcugggacgcguccaauucgcuacagauacuaauaacgacuuugagaccaaucagaacacaaaauucacuccagugggugucauccaggauggcagcaccacaccccgaaaugaaccgcaacaguggguguugccuucguacucugggagaaacauucacaauguucaccucgccccagcaguggcccccaccuuuccuggagagcagcuguuauucuuuagguccacuaugcccggcuguucagguuauccaaacauggaccuggauugccuccuuccucaggaauggguacaacauuucuaccaggaggcugcgcccgcacagagugacgucgcccuguugcgguuugugaacccagauacggggcguguucuauucgaguguaagcugcacaaaagcggcuaugugacagucgcucauaccggacagcacgaccucgugauaccgccuaauggcuacuuucgcuucgauuccuggguaaaccaauucuauacucuggcccccauggggaauggaaccgguagaaggcgguga

SEQ ID NO: 21120 - RNA, 1617 nt, Artificial Sequence
  derived and/or modified sequence opt3 from VP1__Norovirus_and/or_Norovirus-like__KX353959
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucugccaccccgaggaacgaaccucaacaguggguuuugccauccuacagcgggcggaauauccauaacgugcaccucgcacccgccguagcuccuacauuucccggagagcagcuguuauucuuucguucgaccaugccaggcuguucugguuauccuaauauggaucuggacugccuccuuccccaggaauggguccaauacuucuaucaggaggcggcaccagcccaguccgauguggcucuguugcgcuuuguuaacccggacacugggagagugcuauucgaguguaagcugcacaaaucaggcuacgucacgguggcccauacaggacagcacgaucucguaauuccucccaacggcuauuuuagguucgacaguugggugaaucaauucuacacccuggcaccaauggggaacggaacuggucggcgacgcuga

SEQ ID NO: 21121 - RNA, 1617 nt, Artificial Sequence
  derived and/or modified sequence opt3 from VP1__Norovirus_and/or_Norovirus-like__KX353954
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggucgauccauaaugugcaccucgcccccgcaguagccccuaccuuucccggagagcagcuguuauucuuucguucuacuaugccaggcuguuccgguuauccuaacauggaucuggacugccuccuuccccaggaauggguccaauacuucuaucaggaggcugcgccagcacagucagauguggcccuguugcgcuuuguuaauccggacacggggagagugcuauucgaguguaagcugcacaaaaguggcuacgucacaguggcucauaccggacagcacgaucucguaauuccucccaacggcuauuuuagguucgacagcugggugaaccaauucuacacucuggccccaauggggaauggaaccggucggcgacgcuga

SEQ ID NO: 21122 - RNA, 1617 nt, Artificial Sequence
  derived and/or modified sequence opt3 from VP1__Norovirus_and/or_Norovirus-like__AB972529
augaagauggccagcuccgacgcuaaccccucugauggcucagcagccaaucuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugauagggacuuugaagcaaaucagaacaccaaauucacaccaguuggugugauccaggauggcucuacuacccaucggaaugagccccaacaguggguauugccguccuacagcgggcguaacacaccuaauguccaccucgccccagcuguggcgcccaccuuuccuggagaacagcuguuauucuuucgcucgacuaugcccggcuguucugguuauccaaacauggaccuggauugccuccuuccucaggaguggguucaauacuucuaucaggaggcagcccccgcucaguccgacguggcccuguugagauuugucaauccagauacggggagggugcuauucgaauguaagcugcacaaaucaggcuacguaacaguggcacauaccggacagcacgaccucguuauuccgccuaacggcuauuuucgguucgauaguugggucaaucaauucuacacucuggcccccauggggaacggaaccggucgacgcagauga

SEQ ID NO: 21123 - RNA, 1617 nt, Artificial Sequence
  derived and/or modified sequence opt3 from VP1__Norovirus_and/or_Norovirus-like__AB972504
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaacuccugcuccacuggguacacccgacuucgucgggaagauacagggagugcuuacccagacuacacgcaccgacggcucaacgcgaggccacaaggccaccgucuacacagggagcgcugauuuugccccuaagcugggaagagugcaauucgagacugacaccgaucaugacuuugaagcaaaccagaauacaaaauucacuccaguuggugugauucaggauggcaguaccacacacaggaacgagccccaacaguggguauugccgucuuacuccgggcggaauaccccuaacguccaccucgccccagcuguggcgcccacuuuuccuggagaacagcuguuauucuuucguagcacgaugcccggcuguucggguuauccaaauauggaccuggauugccuccuuccucaggaguggguucaauacuucuaucaggaggcagcccccgcucagucugacguggcccuguugcgcuuugucaacccagauacagggagagugcuauucgaauguaagcugcauaaauccggcuacguaaccguggcacacacuggacagcaugaccucguuaucccgccuaauggcuauuuuagguucgauucaugggucaaccaauucuacacccuggcccccauggggaacggaacaggucggcgacgcuga

SEQ ID NO: 21124 - RNA, 1617 nt, Artificial Sequence
  derived and/or modified sequence opt3 from VP1__Norovirus_and/or_Norovirus-like__AB972503
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaacuccugcuccacuggguacacccgacuucgucgggaagauacagggagugcuuacccagacuacacgcaccgacggcucaacgcgaggccacaaggccaccgucuacacagggagcgcugauuuugccccuaagcugggaagagugcaauucgagacugacaccgauagggacuuugaagcaaaccagaauacaaaauucacuccaguuggugugauucaggauggcaguaccacacaucggaacgagccccaacaguggguauugccgucuuacuccgggcguaauaccccuaacguccaccucgccccagcuguggcgcccacuuuuccuggagaacagcuguuauucuuucgcagcacgaugcccggcuguucggguuauccaaauauggaccuggauugccuccuuccucaggaguggguucaauacuucuaucaggaggcagcccccgcucagucugacguggcccuguugagauuugucaacccagauacagggagggugcuauucgaauguaagcugcacaaauccggcuacguaaccguggcacauacuggacagcacgaccucguuaucccgccuaauggcuauuuucgguucgauucaugggucaaccaauucuacacccuggcccccauggggaacggaacaggucgacgcagauga

SEQ ID NO: 21125 - RNA, 1617 nt, Artificial Sequence
  derived and/or modified sequence opt3 from VP1__Norovirus_and/or_Norovirus-like__KP244322
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccagagaugacguguucaccgucagcugcaggguucugacacggccgaguccugauuuugacuucauuuuucucgugcccccaaccguagaaucccgcacuaaaccuuucucugugcccgucuuaacaguggaggaaaugaccaauagcagauuuccaaucccccuggagaaacuuuucacggggccuuccucagcguucguugugcagccacagaacggaagguguacuaccgauggugucuugcugggcacaacucaacuaaguccggugaauauaugcaccuuucgcggggacguaacacauauuagcggaucucggaacuacaccaugaaucucgccucccagaacuggaacucauaugaucccacggaggaaaucccugcaccacugggcacucccgacuucguugguaagauucagggggugcuuacacagaccacucgaacagacggaagcaccagaggccacaaggcuacggucuacaccggcagugccgauuuuucuccuaagcuggggagggugcaauucgcuacagacacugauaaugacuuugagaccaaucagaacacaaaauucacuccagucggagugauccaggaugguggcaccacacaucggaaugaaccccaacaguggguuuugccgaacuacuccgggcguaauacccacaacgugcaccucgccccugcaguagccccaacuuuucccggagagcagcuguuauucuuucgcagcacgaugccuggcuguucggguuaucccaauauggaccuggauugccuccuuccacaggaauggguccaauacuucuaucaggaggcugcgccugcacagucugacguggcccuguugagauuuguuaaccccgauacagggagggugcuauucgaguguaagcugcauaaauccggcuacgucaccguggcucacacuggacagcaugaccucguaaucccaccgaacggcuauuuucgguucgauucaugggugaaucaauucuacacccuggccccuauggggaacggaacaggucgacgcagauga

SEQ ID NO: 21126 - RNA, 1617 nt, Artificial Sequence
  derived and/or modified sequence opt3 from VP1__Norovirus_and/or_Norovirus-like__LC018706
augaagauggccagcuccgacgcuaaccccucugauggcucagcagccaaucuggugccugaggucaacaaugaagacauggcgcucgagccaguugugggggcugccaucgcagccccgguagcuggacagcaaaacgugauugaucccuggauaagaaauaacuucguccaggcaccugguggcgaauuuaccgugaguccaaggaaugcccccggggagauccuuuggagcgcuccucugggaccagacuugaaccccuacuuaucccaccuggcccggauguauaauggcuacgcggguggguucgaaguucaggugauucuagcaggaaacgccuuuacagcuggcaaagucaucuucgccgcagugccuccaaauuuuccgacugagggccucucucccucgcagguaacgauguucccucauauuguuguggauguccgccaacuggagccagugcuuaucccccugccugacgugcgaaacaauuuuuaucacuacaaccagucaaaugauccaaccauaaaguugaucgcuaugcucuauacaccccugcgugccaacaacgcgggggacgaugucuucacuguuagcugcagagugcugaccaggccgaguccugacuuugauuucauuuuucucguacccccaacaguggaaucccggaccaaaccuuucucuguccccguguuaacuguugaggaaaugacaaauagccgcuuuccaaucccccuggagaaacuuuucaccggaccuuccucagccuucgugguccagccacagaacgguagauguacgacugacggcguguugcuggggaccacacaacuaaguccgguaaauauuugcacuuuuaggggagauguuacccauaucacaggcagccggaacuacaccaugaaucucgcaucucagaacuggaauaacuaugaccccacggaggaaauaccugcuccacuggguacucccgacuucguggggaagauucagggaguccuuacacagaccacucgcacagauggcuccacccgaggccacaaggccacgguguacaccgggucagcuaauuuuagcccuaagcugggaagaguccaauucgagacagacacugaucaugacuuugaagugaaccagaauaccaaauucacaccaguuggugugauccaggauggcgggacuacccacaggaacgagccccaacaguggguauugccgaguuacucuggacggaauacaccuaacguccaccucgccccagcaguggcccccaccuuuccuggcgaacagcuguuauucuuucguuccacuaugcccgguuguagcggguauccaaauauggaccuggauugccuccuuccucaggaguggguucaauacuucuaucaggaggcugcgcccgcacagucggacguggcccuguugcgcuuugucaacccagauacgggcagagugcuauucgaauguaagcugcauaaaucuggauacguaacaguggcucacaccggccagcaugaccucguuauuccgccuaacggguauuuuagguucgauuccugggucaaucaauucuacacucuggcccccaugggaaacgguaccggccggcgacgcuga

SEQ ID NO: 21127 - RNA, 1617 nt, Artificial Sequence
  derived and/or modified sequence opt3 from VP1__Norovirus_and/or_Norovirus-like__KP096345
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugggguaauuaugaucccacggaggaaauaccugcuccacuggggacucccgacuucgucggaaagauucagggcgugcuuacacagaccacucgcacagacggcuccacccgagggcacaaggccacggucuacaccggaucagcugauuuugccccuaagcuggguagagugcaauucgagacagacacugaucaugacuuugaagcaaaccagaauaccaaauucacaccaguuggcgugauccaggaugggagcacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggaccuggauugccuccuuccucaggaguggguucaauacuucuaucaggaggcagcccccgcucagucggacguggcccuguugcgcuuugucaacccagauacgggcagagugcuauucgaauguaagcugcauaaaucuggauacguaacaguggcacacaccggccagcaugaccucguuauuccgccuaauggguauuuuagguucgauuccugggucaaccaauucuacacucuggcccccaugggaaacgguaccggccggcgacgcuga

SEQ ID NO: 21128 - RNA, 1617 nt, Artificial Sequence
  derived and/or modified sequence opt3 from VP1__Norovirus_and/or_Norovirus-like__KM982939
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggaaugcuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauccaggauggcaguacuacccacaggaacgagccccaacaguggguguugccgucuuacuccgggcggaauacaccuaacguacaccucgccccagcugucgcgcccaccuuuccuggagaacagcuguuauucuuucguagcacuaugcccggcuguucggguuauccaaauauggaccuggauugccuccuuccucaggagugggugcaauacuucuaucaggaggcagcccccgcucagucugacguugcccuguugcgcuuugugaacccagauacggggagaguccuauucgaauguaagcugcauaaauccggcuacgugacaguagcauauaccggacagcacgaccucgugauuccgccuaauggcuacuuuagguucgauucauggguuaaccaauucuauacucuggcccccauggggaacggaaccggucggcgacgcuga

SEQ ID NO: 21129 - RNA, 1617 nt, Artificial Sequence
  derived and/or modified sequence opt3 from VP1__Norovirus_and/or_Norovirus-like__KM198588
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggcacucccgagcuacagugguagagaugugcacaacguucaucuggccccugcuguggcgccaacuuuucccggggagcaguuacuguucuuuaggucuacgaugccuggcuguuccggauaucccaauauggaccucgauugccuucugccacaggaguggguacagcacuucuaccaagaagcagccccugcucagagcgacgucgccuugcuacgguuugugaaccccgauacaggccguguucuguucgaguguaaacuccauaagucgggguaugugaccgucgcacacacuggacagcacgaccuggugauuccaccgaaugguuacuuucgcuucgauucuuggguaaaccaguucuauacccuugccccuaugggcaacgggacaggaagaaggcgguga

SEQ ID NO: 21130 - RNA, 1617 nt, Artificial Sequence
  derived and/or modified sequence opt3 from VP1__Norovirus_and/or_Norovirus-like__KM198544
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucaucugaucguugacgugcgccaacuugagccaguccugauacccuugccugaugugcgaaacaauuuuuaucacuacaaccagucaaaugacccaacaaucaagcucauugcaaugcuguauacuccccugcgugcuaacaacgccggggaugacguguucaccgucagcugcagaguucucacaaggccgaguccugauuuugacuucaucuuuuuagugcccccaaccguagaaucccggacuaaaccuuucucugugcccguccugacaguggaggaaaugaccaauagccgcuuuccaauuccccuugagaaguuguucacgggaccuuccucagcguucguugugcagccacagaacgguagauguacuaccgauggcguccugcuagggacaacucaacucaguccggugaauaucugcaccuuuaggggagacguaacacauauaagcggcucucggaacuacaccaugaaucuggccucccagaacuggaacucauaugaucccacggaggaaauuccugcaccacuugguacucccgacuucguugggaaaauccagggagugcugacacagaccacucgcacaaauggcagcacccgaggccacaaggcuacggucuacaccgggagugccgacuuuucuccuaaguugggaagagugcaauucgcuacagauacugacaaugauuuugagaccaaccagaauacaaaauucacuccagucggugugauucaggacggcuccaccacacccaggaacgaaccgcaacaguggguucucccuagcuacucggggcggaauauccauaacgugcaccuggccccagcaguagcccccaccuuuccuggagagcaguuacuguucuuucguucuacuaugcccggcuguuccgguuauccaaauauggaucucgacugccuucugccucaggaauggguccaauacuucuaucaggaggcugcgcccgcacagucagauguggccuugcuacgcuuuguuaacccagacacggggagagugcuguucgaguguaagcuccacaaaaguggcuacgucacaguggcucauaccggacagcacgaucugguaaucccgccuaacggcuauuuuagguucgacagcugggugaaucaauucuacacucuugcccccauggggaacggaaccggucggcgacgcuga

SEQ ID NO: 21131 - RNA, 1617 nt, Artificial Sequence
  derived and/or modified sequence opt3 from VP1__Norovirus_and/or_Norovirus-like__KM198522
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcgcgucauucuagcaggaaacgccuuuacagcuggcaaaaucauuuucgccgcagugccuccaaauuuuccgacugagggccucucucccucgcagguaacgauguucccucauaucauaguugacgugcgacagcuggagccaguccuuaucccccugccugaugugcguaacaauuuuuaucacuacaaccaaaccaaugacucaacaauuaaguugaucgcuaugcucuauacuccacugagagccaacaacgcgggggaagauguguucaccgucagcugcaggguucugacacggcccaguccggacuuugauuucauuuuucucgugccucccaccguagagucccgcacuaaaccauucacagugccuaucuuaaccgucgaagagaugacuaauucuagauuucccauaccacuggagaaacuuuucacgggacccagcggugccuucgugguucagccucagaacgggagguguaccacagacggcguguugcugggaacuacccagcuauccccagucaauauuugcacauuucggggcgaugugacccauaucgcagguucacgcaacuacacgaugaaucucgcuagucugaacuggaauaacuaugacccgacugaagagauucccgccccucuugggacaccagauuucguaggaaagauccaaggcguucugacccagacuacaaagggcgacgggagcacccgaggacacaaggcuacgguguacaccgguucugcccccuuuacaccuaaauugggcuccguccaguucucaacugacaccgaaaaugauuuugagacacaucagaacacuaaguucaccccagugggggucauccaagacggaggcacaacccacagaaaugaaccccagcagugggugcucccgagcuacagugguagggauguucacaacgugcaucuggccccugcaguagcuccaacuuuucccggggagcaauuacuguucuuucggucuacgaugccuggcuguuccggauaucccaauauggaccucgauugccuucugccacaggaguggguccagcacuucuaccaggaagcggccccugcacaaagcgacguggcuuugcuacguuuuguuaaccccgauacaggccgcgugcuguucgaguguaaacuccauaagucgggguaugucaccguggcccacacuggacagcacgaccugguaauuccaccgaaugguuacuuuagauucgauucuugggugaaccaguucuauacccuugcaccuaugggcaacgggacaggaaggcggcgauga

SEQ ID NO: 21132 - RNA, 1617 nt, Artificial Sequence
  derived and/or modified sequence opt3 from VP1__Norovirus_and/or_Norovirus-like__KM198508
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagagauguucacaacgugcaucuggccccugcaguagcuccaacuuuucccggggagcaguuacuguucuuuaggucuacgaugccuggcuguuccggauaucccaauauggaccucgauugccuucugccacaggaguggguccagcacuucuaccaagaagcggccccugcacagagcgacgcugccuugcuacgguuugugaaccccgauacaggccguguucuguucgaguguaaacuccauaagucgggguaugugaccgucgcacacacuggacagcacgaccuggugauuccaccgaaugguuacuuucgcuucgauucuuggguaaaccaguucuauacccuugccccuaugggcaacgggacaggaagaaggcgguga

SEQ ID NO: 21133 - RNA, 1617 nt, Artificial Sequence
  derived and/or modified sequence opt3 from VP1__Norovirus_and/or_Norovirus-like__KJ716367
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaaucgugcaauucgagacagacacugaucaugacuuugaagcaaaccagaauaccaaauucacaccaguuggugugauucaggauggcaguacuacccacagaaacgagccccaacaguggguauugccgucuuacuccgggaggaauacaccuaacguccaccucgccccagcuguggcgcccaccuuuccuggagaacagcuguuauucuuucggagcacuaugcccggcuguucggguuauccaaauauggaccuggauugccuccuuccucaggaguggguucaauacuucuaucaggaggcagcccccgcucagucugacguggcccuguugcguuuugucaacccagauacggggcgcgugcuauucgaauguaagcugcauaaauccggcuacguaacaguggcacacaccggacagcaugaccucguuaucccgccuaauggcuauuuuagauucgauucaugggucaaccaauucuacacucuggcccccauggggaacggaaccgguaggcggcgauga

SEQ ID NO: 21134 - RNA, 1617 nt, Artificial Sequence
  derived and/or modified sequence opt3 from VP1__Norovirus_and/or_Norovirus-like__KF177440
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacaccuaauguccaccucgccccagcuguggcgcccaccuuuccuggcgaacagcuguuauucuuucguucuacuaugcccgguuguuccggguauccaagcauggaccuggauugccuccuuccucaggaguggguucaauacuucuaucaggaggcagcccccgcucagucggacguggcccuguugcgcuuugucaacccagauacgggcagagugcuauucgaauguaagcugcauaaaucuggauacguaacaguggcacacaccggccagcaugaccucguuauuccgccuaauggguauuuuagguucgauuccugggucaaccaauucuacacucuggcccccaugggaaacgguaccggccggcgacgcuga

SEQ ID NO: 21135 - RNA, 1617 nt, Artificial Sequence
  derived and/or modified sequence opt3 from VP1__Norovirus_and/or_Norovirus-like__KF060117
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucauaguugacgugcgccaacuggagccaguccuuaucccccugccugaugugcgaaauaacuuuuaucauuacaaucagucaaacgacccaacaauuaaguugaucgcaaugcucuauacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacacauuagcggcucucggaauuacaccaugaaccucgccucccagaauuggaacucauaugaucccacggaggaaaucccugcaccacuggguacucccgacuucguugggaagauucagggagugcuuacacagaccacucgcacagacggcagcacccgaggccauaaggcuacggucuacaccgggagugccgauuuuucuccuaagcugggaagagugcaauucgcuacagacacugauaaugacuuugucaccaaccagaauacaaaauucacuccaguggguguuauccaggauggcuccaccacacccaggaacgagccgcaacaguggguguugccuagcuacucggggcggaauacccacaacguacaccucgccccagcagucgcccccacuuuuccuggagaacagcuguuauucuuucguucuacgaugcccggcuguuccgguuauccaaauauggaccuggauugccuccuuccucaggagugggugcaauacuucuaucaggaagcugcgcccgcacagucagacguugcccuguugcgcuuugugaacccagauacagggagaguccuauucgaguguaagcugcauaaaaguggcuacgugaccguagcucacacuggacagcaugaccucgugaucccgccuaauggcuauuuuagguucgauagcuggguuaaccaauucuacacccuggcccccauggggaacggaacaggucggcgacgcuga

SEQ ID NO: 21136 - RNA, 1617 nt, Artificial Sequence
  derived and/or modified sequence opt3 from VP1__Norovirus_and/or_Norovirus-like__KF060104
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaucuuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauuucuggcucccggaauuacaccaugaaccucgccucacagaauuggaacagcuaugaucccacggaggaaaucccugcaccacuggguacucccgacuucguugggaagauucagggagugcuuacacagaccacucgcacagacggcaguacccgaggccacaaggcuacggucuacaccgggucugccgauuuuuccccuaagcugggaagagugcaauucgcuacagacacugauaaugacuuugucaccaaccagaauacaaaauucacuccaguggguguuauccaggauggcagcaccacacccaggaacgagccgcaacaguggguguugccuucguacucugggcggaauacccauaacguacaccucgccccagcagucgcccccacuuuuccuggagaacagcuguuauucuuucguuccacgaugcccggcuguucagguuauccaaauauggaccuggauugccuccuuccucaggagugggugcaauacuucuaucaggaagcugcgcccgcacagagugacguugcccuguugcgcuuugugaacccagauacagggagaguccuauucgaguguaagcugcacaaaagcggcuacgugaccguagcucauacuggacagcacgaccucgugaucccgccuaauggcuauuuuagguucgauuccuggguuaaccaauucuacacccuggcccccauggggaacggaacaggucggcgacgcuga

SEQ ID NO: 21137 - RNA, 1617 nt, Artificial Sequence
  derived and/or modified sequence opt3 from VP1__Norovirus_and/or_Norovirus-like__KF060095
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccggugcguucguugugcagccacagaacggcagauguacuaccgauggggucuugcugggaacaacucaacuaucaccggugaauauaugcaccuuuaggggcgacguaacacauauuagugguagccggaacuacaccaugaaucucgccucucagaacuggaacuccuaugaucccacggaggaaaucccugcaccacuggggacucccgacuucguuggaaagauucagggcgugcuuacacagaccacucgcacagacggcucaacccgagggcacaaggcuacggucuacaccggaagcgccgauuuuaguccuaagcuggguagagugcaauucgcuacagacacugauucugacuuugucaccaaucagaauacaaaauucacuccagugggcguuauccaggauggguccaccacacccaggaacgagccgcaacaguggguguugccuagcuacucgggacggucuacccauaauguacaccucgccccagcagucgcccccacuuuuccuggcgaacagcuguuauucuuucguuccacgaugcccgguuguucaggguauccaaacauggaccuggauugccuccuuccucaggagugggugcaauacuucuaucaggaagcugcgcccgcacagagugacguugcccuguugcgcuuugugaauccagauacaggcagaguccuauucgaguguaagcugcacaaaagcggauacgugaccguagcucauacuggccagcacgaccucgugaucccgccuaacggguauuuuagguucgauuccuggguuaaucaauucuacacccuggcccccaugggaaacgguacaggccggcgacgcuga

SEQ ID NO: 21138 - RNA, 1617 nt, Artificial Sequence
  derived and/or modified sequence opt3 from VP1__Norovirus_and/or_Norovirus-like__KF060084
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucaccaaucagaacacaaaauucacuccaguggguguuauccaggauggcuccaccacacccaggaaugagccgcaacaguggguguugccuagcuacucggggcggaacacccauaauguacaccucgccccagcagucgcccccacuuuuccuggagaacagcuguuauucuuucguucuacgaugcccggcuguuccgguuauccaaacauggaccuggauugccuccuuccucaggagugggugcaauacuucuaucaggaagcugcgcccgcacagucagacguugcccuguugcgcuuugugaauccagauacagggagaguccuauucgaguguaagcugcacaaaaguggcuacgugaccguagcucauacuggacagcacgaccucgugaucccgccuaacggcuauuuuagguucgauagcuggguuaaccaauucuacacccuggcccccauggggaauggagcaggucggcgacgcuga

SEQ ID NO: 21139 - RNA, 1617 nt, Artificial Sequence
  derived and/or modified sequence opt3 from VP1__Norovirus_and/or_Norovirus-like__KF060082
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaucaggcuacgucacaguggcucauaccggacaguaugaucucguaauuccucccaacggcuacuuuagguucgacaguugggugaaucaauucuauacucuggccccaauggggaacggaaccggucggcgacgcuga

SEQ ID NO: 21140 - RNA, 1617 nt, Artificial Sequence
  derived and/or modified sequence opt3 from VP1__Norovirus_and/or_Norovirus-like__KF060079
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggucaagcuaugaucccacggaggaaaucccugcaccacuggguacucccgacuucguugggaagauucagggagugcuuacacagaccacucgcacagacggcaguacccgaggccacaaggcuacggucuacaccgggucugccgauuuuuccccuaagcugggaagagugcaauucgcuacagacacugauaaugacuuugucaccaaccagaauacaaaauucacuccaguggguguuauccaggauggcagcaccacacccaggaacgagccgcaacaguggguguugccuucguacucugggcggaauacccauaacguacaccucgccccagcagucgcccccacuuuuccuggagaacagcuguuauucuuucguuccacgaugcccggcuguucagguuauccaaauauggaccuggauugccuccuuccucaggagugggugcaauacuucuaucaggaagcugcgcccgcacagagugacguugcccuguugcgcuuugugaacccagauacagggagaguccuauucgaguguaagcugcacaaaagcggcuacgugaccguagcucauacuggacagcacgaccucgugaucccgccuaauggcuauuuuagguucgauuccuggguuaaccaauucuacacccuggcccccauggggaacggaacaggucggcgacgcuga

SEQ ID NO: 21141 - RNA, 1617 nt, Artificial Sequence
  derived and/or modified sequence opt3 from VP1__Norovirus_and/or_Norovirus-like__KF060058
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccagcacuauccuuugguccgccccucuggggccagauuugaaccccuacuuaucucaccuggcucggauguauaauggauacgccggcgguuucgaggugcaggucauucuagcggggaacgcauuuacggccggaaaaaucauuuucgcugccgugccuccaaauuuuccgaccgaaggccucucgcccucacagguaacaauguucccucauaucauaguugacgugcgccaacuggagccaguccuuaucccccugccugaugugcgaaacaauuuuuaucacuacaaccagagcaaugacccaacuauuaaguugaucgcaaugcucuauacgccccugcgugcuaacaacgccggcgaugacguguucacagucaguugcagaguucugaccaggccguccccugauuuugacuucauuuuucucgugcccccaacuguagagucucggacaaaaccuuucagcgugcccgucuuaaccguggaagagaugaccaauucccgcuuuccaaucccccuggaaaaacuuuucacugggccuucaagugcguucguugugcagccacagaacggaagauguaccacagauggugucuugcugggcacuacccaacuaagcccggugaauauaugcacauuuaggggagacguaacccauauuucugggucccggaacuacacgaugaaucucgccucacagaacuggaauagcuaugaucccacugaggagaucccugcaccacugggcacacccgacuucguugguaagauucagggggugcuuacccagacuacacgcaccgacggaaguacgcgaggccacaaggcuaccgucuacacaggcucugccgauuuuuccccuaagcuggggagagugcaauucgcuacugacaccgauaacgacuuugucacaaaucagaacacuaaauucaccccagugggaguuauccaggaugguagcacaacccccaggaaugaaccgcaacaguggguguugccuucguacucuggccggaacauccauaauguacaccucgccccagcagucgcccccacuuuuccuggggagcagcuguuauucuuucguuccacgaugcccggauguucaggcuauccaaacauggaccuggauugccuccuuccucaggaaugggugcaauacuucuaucaggaggcugcgcccgcacagagugacguugcccuguugcgcuuugugaauccagauacagguagaguccuauucgaauguaagcugcacaaaagcggguacgugaccguagcucauacuggccagcacgaccucgugauuccgccuaacggauauuuuagguucgauuccuggguuaaccaauucuacacccuggcccccaugggcaaugggacaggacggcgacgcuga

SEQ ID NO: 21142 - RNA, 1617 nt, Artificial Sequence
  derived and/or modified sequence opt3 from VP1__Norovirus_and/or_Norovirus-like__KF060039
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaagcgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauuucuggcucccggaauuacaccaugaaccucgccucacagaauuggaacagcuaugaucccacggaggaaaucccugcaccacuggguacucccgacuucguugggaagauucagggagugcuuacacagaccacucgcacagacggcaguacccgaggccacaaggcuacggucuacaccgggucugccgauuuuuccccuaagcugggaagagugcaauucgcuacagacacugauaaugacuuugucaccaaccagaauacaaaauucacuccaguggguguuauccaggauggcagcaccacacccaggaacgagccgcaacaguggguguugccuucguacucugggcggaauacccauaacguacaccucgccccagcagucgcccccacuuuuccuggagaacagcuguuauucuuucguuccacgaugcccggcuguucagguuauccaaauauggaccuggauugccuccuuccucaggagugggugcaauacuucuaucaggaagcugcgcccgcacagagugacguugcccuguugcgcuuugugaacccagauacagggagaguccuauucgaguguaagcugcacaaaagcggcuacgugaccguagcucauacuggacagcacgaccucgugaucccgccuaauggcuauuuuagguucgauuccuggguuaaccaauucuacacccuggcccccauggggaacggaacaggucggcgacgcuga

SEQ ID NO: 21143 - RNA, 1617 nt, Artificial Sequence
  derived and/or modified sequence opt3 from VP1__Norovirus_and/or_Norovirus-like__KF060030
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggaacgcuccucugggaccagauuugaaucccuacuuaagccaccuggcccggauguauaacggcuacgcggguggguucgaagugcaggucauucuagcaggaaaugccuuuacagcuggcaaagugaucuucgccgcaguaccuccaaacuuuccgacugagggccucucccccucucagguuacgauguucccucauauuguggucgacgugcgccaacuggagccagugcuuaucccccugccugauguccgaaauaacuuuuaucacuacaaucagucgaacgacccaaccauaaaguugaucgcuaugcucuauacaccccugcgugccaacaaugcgggggaugacguuuucacugugucaugcagaguacugaccaggccgagcccugauuuugacuucauuuuucucgugcccccaacagucgaaagucggaccaaaccuuucuccgugcccguuuuaacuguggaggaaaugacaaacucucgcuuuccaaucccccuggagaaacuuuucaccggaccuagcuccgccuucgucgugcagccacagaaugguagauguacgacugauggcguauugcuggggaccacacaacuaucaccgguuaacauuugcacuuuuaggggagacgugacccauaucacaggcagucggaauuacaccaugaaccucgcaagccagaauuggaacaauuaugaucccacggaggaaauaccugcuccacuggguacucccgacuucgucgggaagauucagggagugcuuacacagaccacucgcacagacggcucuacccgaggccacaaggccacggucuacaccggguccgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgucauacagcggacggaauacacacaacguccaucucgccccugcuguggcgccaaccuuucccggcgaacagcuguuauucuuucguaguacuaugccugguuguucuggguaucccaauauggaccuggauugccuccuuccacaggaguggguucaauacuucuaucaggaggcagccccugcucaguccgacguggcccuguugcgcuuugucaaccccgauacgggcagagugcuauucgaauguaagcugcacaaaagcggauacgcaacaguagcccauaccggccagcacgaccucgugauuccaccgaacggguauuuuagguucgauucguggguuaaucaauucuacacucuggcuccuaugggaaacgguaccggccggcgacgcuga

SEQ ID NO: 21144 - RNA, 1617 nt, Artificial Sequence
  derived and/or modified sequence opt3 from VP1__Norovirus_and/or_Norovirus-like__JX439829
augaagaugggcagcaacgacgccaaucccuccgaugggucuaccgcuaaccuggugccugaggucaauaacgaaguuauggcacucgagccagugguaggagccgcgaucgcugccccgguggcaggucagcaaaaugucauugaccccuggauaagaaacaauuucgugcaggccccuggcggggaauuuacaguuucaccaaggaacgcucccggagagauccuuuggagugcaccucugggcccagauuugaaucccuacuuaagccaccuggcccggauguauaacgguuacgcugggggauucgaagugcaggucauucuagccggcaaugcguuuacugcaggcaaaaucauuuucgccgcugugccuccaaacuuuccgacggaggggcucucccccucucagguaaccauguucccucauaucauaguugacgugcgccaacuggagccaguccuuaucccccugccugaugugcgaaauaacuuuuaucacuacaaucagucgaacgacccaacaauuaaguugaucgccaugcucuauacuccccugcgugcaaacaaugcuggagaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaacucucgcuuuccaaucccccuggagaaacuuuucacggguccuagcuccgccuucguugugcagccacagaauggcagauguacuaccgauggggucuugcugggaacaacucaacuaucaccggugaacauaugcaccuuuaggggcgacguaacacauauucccgguagucggaauuacaccaugaaccucgcgagccagaauuggaacucuuaugauccuacggaggaaaucccagcaccccuggggacuccugacuucguuggaaagauucagggcgugcuuacacagaccacucgcacaaauggcuccacccgagggcacaaggccacggucuacaccggaucagcugacuuuagcccaaagcuggguagagugcaauucgccacagauacugacaacgauuuugagaccaaucagaacacaaaauucacucccgucggcgugauccaggacgggaguaccacaccgaggaaugaaccucaacaguggguuuugccaucuuacuccggacggaacauccauaaugugcaccucgcucccgccguagcaccuaccuuucccggcgagcagcuguuauucuuucguagcacuaugccagguuguucgggguauccuaacauggaucuggacugccuccuuccccaggaauggguccaauacuucuaucaggaggccgcuccagcgcagucugauguggcacuguugcgcuuuguuaacccggacacgggcagagugcuauucgaguguaagcugcacaaauccggauacgucacaguggcccauaccggccagcacgaucucguaauuccucccaauggguauuuuagguucgacucaugggugaaccaauucuacacucuggcuccaaugggaaaugguaccggccggcgacgcuga

SEQ ID NO: 21145 - RNA, 1617 nt, Artificial Sequence
  derived and/or modified sequence opt3 from VP1__Norovirus_and/or_Norovirus-like__KC409282
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagacacccgccccucuugggaccccagauuucguaggaaagauucagggcguucugacucagacaaccaagggcgacgggagcacgcgcggacacaaggcuaccguguacacagguucugcccccuuuacuccuaaauugggcuccguccaguucucaaccgacacagaaaaugauuuugagacucaucaaaacaccaaguucacaccagugggggucauccaggacggaggcaccacucaccgaaaugaaccccagcaaugggugcucccgagcuacagugguagagauguucacaacgugcaucuggccccugcaguagcuccaacguuucccggggagcaguuacuguucuuuaggucuacaaugccuggcuguuccggauaucccaauauggaccucgauugccuucugccacaggaguggguccagcacuucuaccaagaagcggccccugcacagagcgacguggcuuugcuacgguuuguuaaccccgauaccggccgugugcuguucgaguguaaacuccauaagucgggguaugucacuguggcccacaccggacagcacgaccugguaaucccaccgaaugguuacuuucgcuucgauucuugggugaaccaguucuauacacuugcaccuaugggcaacgggaccggaagaaggcgguga

SEQ ID NO: 21146 - RNA, 1617 nt, Artificial Sequence
  derived and/or modified sequence opt3 from VP1__Norovirus_and/or_Norovirus-like__KC409259
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagagauguucacaacgugcaucuggccccugcaguagcuccaacuuuucccggggagcaguuacuguucuuuaggucuacgaugccuggcuguuccggauaucccaauauggaccucgauugccuucugccacaggaguggguccagcacuucuaccaagaagcggccccugcacagagcgacguggcuuugcuacgguuuguuaaccccgauacaggccgugugcuguucgaguguaaacuccauaagccaggguaugucaccguggcccacacuggacagcacgaccugguaauuccgccuaaugguuacuuucgcuucgauucgugggugaaccaguucuauacccuugcacccaugggcaacgggacaggaagaaggcgguga

SEQ ID NO: 21147 - RNA, 1617 nt, Artificial Sequence
  derived and/or modified sequence opt3 from VP1__Norovirus_and/or_Norovirus-like__JX459659
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucguuguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccguguuaacaguugaggaaaugaccaauagccgcuuuccaauuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauaagcggcucucggaacuacaccaugaaucucgccucccagaacuggaacucauaugaucccacggaggaaauuccugcaccacuggguacucccgacuucguggggaagauccagggaguccuuacacagaccacucgcacagacggcagcacccgaggccacaaggcuacgguguacaccgggagugccgauuuuucuccuaagcugggaagaguccaauucgcuacagacacugauaaugacuuugugaccaaucagaacacaaaauucacuccaguuggugugauucaggauggcuccaccacacccaggaaugagccgcaacaguggguauugccuagcuacucggggcggaacacccauaauguccaccucgccccagcaguggcccccacuuuuccuggagaacagcuguuauucuuucguucuacgaugcccggcuguuccgguuauccaaacauggaccuggauugccuccuuccucaggaguggguucaauacuucuaucaggaagcugcgcccgcacagucagacguggcccuguugcgcuuugucaauccagauacagggagagugcuauucgaguguaagcugcacaaaaguggcuacguaaccguggcucauacuggacagcacgaccucguuaucccgccuaacggcuauuuuagguucgauagcugggucaaccaauucuacacccuggcccccauggggaauggaacaggucggcgacgcuga

SEQ ID NO: 21148 - RNA, 1617 nt, Artificial Sequence
  derived and/or modified sequence opt3 from VP1__Norovirus_and/or_Norovirus-like__JX459658
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucauaguucagccacagaacgguagauguacuaccgauggcguguugcuggggacaacucaacuaaguccggucaauauuugcaccuuuaggggagacgugacacauaucagcggcucucggaacuacaccaugaaucucgccucccagaacuggaacucauaugaucccacggaggaaauuccugcaccacuggguacucccgacuucguagggaagauccagggaguucuuacacagaccacucgcacagacggcagcacccgaggccacaaggcuacgguguacaccgggagugccgauuuuucuccuaagcugggaagaguccaauucgcuacagacacugauaaugacuuugugaccaaucagaacacaaaauucacuccagucggugugauccaggauggcuccaccacacccaggaaugagccgcaacaguggguuuugccuagcuacucggggcggaacacccauaaugugcaccucgccccagcaguagcccccacuuuuccuggagaacagcuguuauucuuucguucuacgaugcccggcuguuccgguuauccaaacauggaccuggauugccuccuuccucaggaguggguccaauacuucuaucaggaagcugcgcccgcacagucagacguggcccuguugcgcuuuguuaauccagauacagggagagugcuauucgaguguaagcugcacaaaaguggcuacgucaccguggcucauacuggacagcacgaccucguaauuccgccuaacggcuauuuuagguucgauagcugggugaaccaauucuacacccuggcccccauggggaauggaacaggucggcgacgcuga

SEQ ID NO: 21149 - RNA, 1617 nt, Artificial Sequence
  derived and/or modified sequence opt3 from VP1__Norovirus_and/or_Norovirus-like__JX459595
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacucaacuauuaaguugaucccaaugcucuauaccccucugcgugcaaacaacgcuggggaugacguguucacagucagcugcagaguucugaccaggccgaguccugauuuugacuucauuuuucucgugcccccaacuguagaaucccggacaaaaccuuucucugugcccaucuuaaccgucgaggaaaugacgaauagccgcuuuccaauaccccuggagaaacuuuucacuggaccuuccucagccuucgugguucagccacagaacgguagauguaccacagauggcguguugcuggggacuacccaacuaaguccggucaauauuugcacauuuaggggagacgugacccauaucgcgggcacgcagagcuacacuaugaaccucgccucucagaauuggaacaauuaugaucccacagaggaaauuccugcaccacuggguacccccgacuucguagggaagauccagggaguucuuacucaaacaacccggggcgacggcuccacgcgcgggcacaaggcuaccgugucaacaggaagcguccauuuuacuccuaagcuggguagugugcaguucucuaccgauacauccaacgacuuugagacuggccagaauacccgauucacaccagucggggugguucaagauggaagcaccacucaccagaacgaaccccagcaguggguguugccgaauuacucgggcagagacucucacaacguacaucucgccccugcugucgccccaacguuucccggugagcaacuguuauucuuuagguccacaaugccuggguguucaggcuaccccaauaugaaccuggauugccuccuuccacaggaaugggugcagcacuucuaucaggagagugcacccgcccaaagcgacguugcucuguugcgguuugugaaucccgauaccggacguguccuauucgaguguaaacugcauaaguccggcuacgugacuguagcgcacaccgggcagcacgaccucgugaucccaccgaacggauauuuucgcuucgauucuuggguuaaccaguucuacacacuggcaccuauggguaauggcgccgggagaaggcgguga

SEQ ID NO: 21150 - RNA, 1617 nt, Artificial Sequence
  derived and/or modified sequence opt3 from VP1__Norovirus_and/or_Norovirus-like__JQ613560
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcgcuaauggcucaacacgaggccacaaggccaccgucuacacggggagcgcugacuuuaguccaaagcugggaagagugcaauucgccaccgauacagacaaugauuuugagacuaaccagaauaccaaauucacacccgucggugugauccaggacggcucuacuaccccgaggaacgaaccucaacaguggguuuugccauccuacagcgggcggaauauccauaacgugcaccucgcacccgccguagcuccuacauuucccggagagcagcuguuauucuuucguucgaccaugccaggcuguucugguuauccuaauauggaucuggacugccuccuuccccaggaauggguccaauacuucuaucaggaggcggcaccagcccaguccgauguggcucuguugcgcuuuguuaacccggacacugggagagugcuauucgaguguaagcugcacaaaucaggcuacgucacgguggcccauacaggacagcacgaucucguaauuccucccaacggcuauuuuagguucgacaguugggugaaucaauucuacacccuggcaccaauggggaacggaacuggucggcgacgcuga

SEQ ID NO: 21151 - RNA, 1617 nt, Artificial Sequence
  derived and/or modified sequence opt3 from VP1__Norovirus_and/or_Norovirus-like__JQ613545
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaauaacuaugauccuacggaggaaaucccagcaccccuggguacuccugacuucguugggaagauucagggagugcuuacacagaccacucgcacaaauggcuccacccgaggccacaaggcuacggucuacaccgggucagccgacuuuagcccaaagcugggaagagugcaauucgcuacagauacugacaacgauuuugagaccaaucagaacacaaaauucacucccgucggugugauccaggacggcaguaccacaccgaggaaugaaccucaacaguggguuuugccaucuuacuccgggcggaacauccauaaugugcaccucgcccccgcaguagccccuaccuuucccggagagcagcuguuauucuuucguagcacuaugccaggcuguucggguuauccuaacauggaucuggacugccuccuuccccaggaauggguccaauacuucuaucaggaggcugcgccagcacagucugauguggcccuguugcgcuuuguuaacccggacacggggagagugcuauucgaguguaagcugcacaaauccggcuacgucacaguggcucauaccggacagcacgaucucguaauuccucccaauggcuauuuuagguucgacucaugggugaaccaauucuacacucuggccccaauggggaauggaaccggucggcgacgcuga

SEQ ID NO: 21152 - RNA, 1617 nt, Artificial Sequence
  derived and/or modified sequence opt3 from VP1__Norovirus_and/or_Norovirus-like__AB541288
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagaucccuuggagugcuccacuuggacccgaucugaauccuuacuugagccacuuagcccggauguauaacggcuacgcggguggguucgaagugcaggucgugcuggcaggaaaugccuuuacagcuggcaaaguaauuuucgccgcaguuccaccgaacuuucccacugagggccuauccccuucucaggugacgauguucccacauaucauugucgacgugcgccaacucgagcccgugcugaucccucuuccagauguccgaaauaacuuuuaucacuacaaucagucgaacgacucaaccauaaagcugaucgcuauguuguauacaccccuccgugccaacaaugcgggggaagauguuuucacugugagcugcagaguacugaccaggccgaguccugacuuugauuucauuuuucuggugcccccaacagucgagucccggaccaaaccuuucacugugcccauccucacaguugaagagaugaccaacucucgcuuuccaauucccuuagagaagcuguucacgggaccuagcggugccuucgugguccagccacagaauggcagauguacuaccgacggggugcuuuugggaacaacucaacuguccccgguaaacaucugcaccuuuaggggcgauguuacacauauagcagguucacggaauuacaccaugaaccuagcuagucucaauuggaacaauuaugaccccacggaagagauuccugccccacuggggacucccgauuucgugggaaaaauccagggcguccuuacacagaccacuaagggcgacgggagcacacgcggacacaaggcuaccguguacacggguucuaccccuuuuacaccaaaacugggcuccguccaguucucaacugacaccgaaaacgauuuugagaaucaucaaaacacaaaguucacucccguggggguuauucaggacggaggcaccacacaccgaaaugaaccgcagcaauggguguugccuagcuacagugguagaaacguacagaauguccaccucgccccagcaguggcccccaccuuuccuggggagcagcuguuauucuuuaggucuacuaugcccggcuguuccggauauccaaacauggaucuggacugccuccuuccucaggaguggguucaacauuucuaccaggaagcugcgcccgcacagagcgauguggcccuguugcgguuugucaacccagacacgggccgugugcuauucgaguguaaacugcacaagucgggguauguaacaguggcucauaccggacagcacgaucucguuaucccgccuaaugguuacuuucgcuucgacucuugggucaaccaauucuauacucuggcccccaugggcaaugggaccggaagaaggcgguga

SEQ ID NO: 21153 - RNA, 1617 nt, Artificial Sequence
  derived and/or modified sequence opt3 from VP1__Norovirus_and/or_Norovirus-like__AB541247
augaagauggccagcaacgacgcuaauagauccgauggcucugcagccaaccuggugcccgaggucaauaacgaaguuauggcgcucgagccugugguaggggcugccaucgcagccccaguggcuggacagcaaaaugucauugacccguggauaaggaacaauuucgugcaggcacccgguggcgaauuuaccguuucaccucggaacgccccaggggagauccuuuggagugcuccccugggaccugauuugaauccauacuuaagccaccuggcccgcauguauaacggcuacgcggguggguucgaagugcaggucauucuagcaggaaaugccuuuacagcuggcaaaaucauuuucgccgcagugcccccuaacuuuccaacugagggccucuccccgucucagguaacgauguucccccauaucauaguugacgugcgacaacuggagccuguccuuaucccacugcccgaugugcguaauaacuuuuaucacuacaaucagucgaacgacucaaccauuaaguugaucgcuaugcucuauacaccucugagagccaacaaugcgggggaagauguguucacugucagcugcaggguucugacccggccaagucccgacuuugauuucauuuuucucgugccgccuacaguagagucccgcaccaaacccuucacugugccaaucuuaacagucgaagagaugaccaacucuagauuuccuauaccccuggagaaacuuuucacgggaccaagcuccgccuucgugguucagccccagaaugguagguguacuaccgacggcguguugcuggggacaacucaacuaucaccugucaacauuugcaccuuucggggagaugugacacauaucgcaggcagucgcaauuacaccaugaaccucgcuagccugaauuggaacaauuaugacccaacggaagagauuccggcaccccuugguacuccugauuucguagggaagauccagggaguucugacacagaccacuaagggcgacggcucuacacgagggcacaaggcuaccguguacacgggauccgccccauuuacccccaaauuggguucaguccaguucagcacagacacugaaaacgauuuugagacccaucaaaauacaaaguucacuccugugggcgucauccaggacgggaguaccacacacagaucugaaccacagcaaugggugcuccccuccuacagcggaaggaacguuccgaaugugcaccuggccccugccguagcuccaaccuuucccggcgagcaguuacuguucuuucggucgacuaugccugguuguucuggguaucccaacauggaucucgacugccuucugccacaggaguggguccagcauuucuaccaagaagcggccccugcacaguccgauguggcuuugcuacguuuuguuaaucccgacacgggccgcgugcuguucgaguguaaacuccacaagucaggauaugucacaguggcccauaccggccagcacgaucugguaauuccaccgaacggguacuuuagauucgacaguugggugaaccaguucuauacucuugcaccuaugggaaaugguaccggcaggcggcgauga

SEQ ID NO: 21154 - RNA, 1617 nt, Artificial Sequence
  derived and/or modified sequence opt3 from VP1__Norovirus_and/or_Norovirus-like__EU839585
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugacgaacucucgcuuucccauaccacuggagaaacuuuucacuggacccagcuccgcguucgugguucagccucagaaugguagauguaccacagauggcguguugcuggggacuacccaacuaucaccagucaacauuugcacauuuaggggagacgugacccauaucccgggcacgcggacuuaccgcaugaaucucgccagucagaacuggaauaacuaugaucccacagaggaaauuccugcaccacuggguacccccgacuucguagggaagauccagggaaugcuuccucagacuacaaagggcgacggcagcacccgagggcacaaggcuacgguuucuaccggauccguggauuuuacaccaaaacuggguucaguccaauucgccacugacaccgauaaugacuuugagacaggccagaacacuagauucacccccgugggggucauccaggauggaagcaguacacauaggaaugaaccgcaacaguggguguugccugacuacucuggccggaccguuuacaacgugcaccucgcuccagccguagcacccacuuuuccuggugagcagcuguuauucuuucguuccacgaugcccggguguagcggcuauccaaauauggaucuggacugccuccuuccucaggaauggguccaacacuucuaccaggaggccgcucccucgcagucugauguggcgcuguugcgcuuuguuaacccagacacaggaagagugcuauucgaguguaagcugcauaaagcaggcuaugucaccguggcccacacugggcagcaugaucucguaauuccgccuaauggauacuuuagguucgacuccugggugaaccaauucuauacccuggcucccauggguaacggcgccgggcggcgacgcuga

SEQ ID NO: 21155 - RNA, 1617 nt, Artificial Sequence
  derived and/or modified sequence opt3 from VP1__Norovirus_and/or_Norovirus-like__AY588021
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccagauucacaccagucggagugguccaggauggcaacgguacccaccaaaaugagccccagcaguggguguugccgucuuacuccgggaggacuggccauaacguucaccucgcuccugccguggcaccaacguuucccggagaacagcuguuauucuuucggucaacaaccccuggcuguagcggguaccccaacaugaaucuggacugccuccuuccacaagaguggguacagcauuucuaucaggaggccgcuccugcgcagagugaugucgcacuguugcguuuugugaaccccgacacuggacgcguucuauucgaauguaagcugcacaaaucugguuacgugaccgucgcccacacaggccaacaugaucucgugauuccaccgaauggguauuuuagauucgacuccuggguaaaccaguucuacacccuggcuccuaugggaaauggcacugguaggcggcgauga

SEQ ID NO: 21156 - RNA, 1617 nt, Artificial Sequence
  derived and/or modified sequence opt3 from VP1__Norovirus_and/or_Norovirus-like__KX514188
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaaccccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaauagccgcuuuccaauaaaccuggauaaacuuuucacgggucccuccucagcgaaugugguucagccucagaacggcagauguacuauugacggggaauugcugggaaccacacaacuaaguccagugaauaucugcacuuucaggggcgaugucacccauccgcgggacagccagauuuacacaaugaaccucgccucucccaauuggaacaauuaugacccuaccgaggagaucccagcaccccuggguacgccugauuuuguggggaagauccagggaaugcuuacucagacaaccaagggcgaaggcuccacucgcgggcaccgagcuacaguauacguuggaucagccaacuacgcuccaaagcuggguagagugcaauucgagaccgacacgaccaaugauuuggacgcccaucagaacacaaaauuuacucccgucggcgugguccaagggggagaaagcccgaagggcagugagccucagcagugggugcucccaucuuauuccgguagggauacccccaauguucaccuggccccugcaguggcucccacauucccaggggaacaguuacuguuuuuccggagcacuauuccuggcuguggaggccaccccaacaugaaucucgacugccuucugccacaggaguggguacaacauuuuuaccaggaggcggcaccggcccagucggaugucgcuuugcuacguuucgugaacccugacaccucucgcguucuguuugaauguaaacuccacaaguccggguaugugacagucgcccauaccggacagcacgaucuggugauacccccaaacgguuacuucagauuugacucauggguaaaucaauucuauacucuugcacccaugggcaacgggacgggaaggaaacgguga

SEQ ID NO: 21157 - RNA, 1617 nt, Artificial Sequence
  derived and/or modified sequence opt3 from VP1__Norovirus_and/or_Norovirus-like__KX354101
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaacuccugcuccacuggguacacccgacuucgucgggaagauacagggagugcuuacccagacuacacgcaccgacggcuccacgcgaggccacaaggccaccgucuacacagggucagcugauuuugccccuaagcugggaagagugcaauucgagacugacaccgauagggacuuugaagcaaaucagaacacaaaauucacuccaguuggugugauucaggauggcgggaccacacaucggaaugagccccaacaguggguauugccgagcuacaguggacguaacacccacaauguccaccucgccccugcuguggcgccaacuuuucccggcgaacagcuguuauucuuucgcucuacgaugccugguuguuccggguaucccaacauggaccuggauugccuccuuccacaggaguggguucaauacuucuaucaggaggcagccccugcucagagcgacguggcccuguugagauuugucaaucccgauacaggcagggugcuauucgaauguaagcugcauaaaucgggauacguaaccguggcacacacuggccagcaugaccucguuaucccaccgaacggguauuuucgguucgauucuugggucaaccaauucuacacccuggccccuaugggaaaugguacaggccgacgcagauga

SEQ ID NO: 21158 - RNA, 1617 nt, Artificial Sequence
  derived and/or modified sequence opt3 from VP1__Norovirus_and/or_Norovirus-like__KX354023
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggaaugcuuacacagaccacucgcgccgacggcuccacacgaggccacaaggcuaccguguacacggggucagccgauuuugcaccuaagcugggaagaguccaauucgagaccgacacagaucaugacuuugaagccaaucagaacacuaaauucaccccaguggguguuauccaggauggcagcacaacucacaggaaugagccccaacaguggguguugccgaguuacucugggcggaacacccacaauguacaucucgcuccuccagucgcgcccacauuuccuggagaacagcuguuauucuuucguuccaccaugcccggcuguagcgguuauccaaacauggaccuggauugccuccuuccucaggagugggugcaauacuucuaucaggaggcagcccccgcucagucggacguugcccuguugcgcuuugugaauccagauacugggagaguccuauucgaauguaagcugcacaaaucuggcuacgugacgguagcacauacaggacagcacgaccucgugauuccgccuaacggcuauuuuagguucgauuccuggguuaaccaauucuacacccuggcccccauggggaauggaacuggucggcgacgcuga

SEQ ID NO: 21159 - RNA, 1617 nt, Artificial Sequence
  derived and/or modified sequence opt3 from VP1__Norovirus_and/or_Norovirus-like__KX353979
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaugaucguugacgugcgccaacuggagccaguccuuauaccccugccugaugugcgaaacaauuuuuaucacuacaaccagucaaaugacccaacaaucaaguugauugcaaugcucuauacuccccugcgugcuaacaacgccggggaugacguguucaccgucagcugcagaguucugacaaggccgaguccugauuuugacuucaucuuucucgugcccccaaccguagaaucccggacuaaaccuuucucugugcccgucuuaacaguggaggaaaugaccaauagccgcuuuccaauuccccuggagaaacuuuucacgggaccuuccucagcguucguugugcagccacagaacgguagauguacuaccgauggcgucuugcuggggacaacucaacuaaguccggugaauaucugcaccuuuaggggagacguaacacauauaagcggcucucggaacuacaccaugaaucucgccucccagaacuggaacucauaugaucccacggaggaaauuccugcaccacuggguacucccgacuucguugggaagauccagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauucaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaaucccgccuaacggcuauuuuagguucgacagcugggugaaucaauucuacacucuggcccccauggggaacggaaccggucggcgacgcuga

SEQ ID NO: 21160 - RNA, 1617 nt, Artificial Sequence
  derived and/or modified sequence opt3 from VP1__Norovirus_and/or_Norovirus-like__AB972491
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugauccauauaaccggcagccggaacuacacaaugaaucucgcaucucagaacugguccaauuaugaucccaccgaggaaauuccugcuccacuggguacgcccgacuucgucgggaagauccagggagugcuuacucagacaacccgcacugacggcucaacacgaggccacaaggccaccgucuacacggggagcgcugauuuugccccuaagcugggaagagugcaauucgagaccgacacagaucaugacuuugaagcaaaccagaauacuaaauucaccccaguuggugugauucaggauggcaguacaacucacaggaacgagccccaacaguggguauugccgucuuacuccgggcggaauaccccuaacguccaccucgccccagcuguggcgcccacauuuccuggagaacagcuguuauucuuucguagcaccaugcccggcuguucggguuauccaaauauggaccuggauugccuccuuccucaggaguggguucaauacuucuaucaggaggcagcccccgcucagucugacguggcccuguugcgcuuugucaacccagauacugggagagugcuauucgaauguaagcugcauaaauccggcuacguaacgguggcacacacaggacagcaugaccucguuaucccgccuaauggcuauuuuagguucgauucaugggucaaccaauucuacacccuggcccccauggggaacggaacuggucggcgacgcuga

SEQ ID NO: 21161 - RNA, 1617 nt, Artificial Sequence
  derived and/or modified sequence opt3 from VP1__Norovirus_and/or_Norovirus-like__AB972469
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacucucaggggagacgugacccauaucacaggcagccggaacuacaccaugaaucuggcaucucagaacugguccaauuaugaucccacggaggaaauaccugcuccacuugguacucccgacuuugucgggaagauucagggagugcugacacagaccacucgcacagacggcucaacccgaggccacaaggccacggucuacaccgggagcgcugauuucgccccuaaguugggaagagugcaauuugagacagacacugauagggacuucgaagcaaaccagaauaccaaauuuacaccaguuggugugauccaggauggcaguacuacccaucggaacgagccccaacaguggguacucccgucuuacuccgggcguaauacaccuaacguccaccuggccccagcuguggcgcccaccuucccuggagaacaguuacuguuuuuccgcagcacuaugcccggcuguucggguuauccaaauauggaccucgauugccuucugccucaggaguggguucaauacuuuuaucaggaggcagcccccgcucagucugacguggccuugcuaagauucgucaacccagauacggggagggugcuguuugaauguaagcuccacaaauccggcuacguaacaguggcacauaccggacagcacgaccugguuauuccgccuaauggcuauuuccgguuugauucaugggucaaccaauucuacacucuugcccccauggggaacggaaccggucgacgcagauga

SEQ ID NO: 21162 - RNA, 1617 nt, Artificial Sequence
  derived and/or modified sequence opt3 from VP1__Norovirus_and/or_Norovirus-like__LC101819
augaagauggccagcaacgacgauaaucccuccgacggcucugcugcaaaccuggugccugaggucaauaacgaaguuauggcccucgagccagugguaggggcggcuaucgccgcaccgguggccggacagcaaaaugucauugaucccuggauaagaaacaauuucgugcaggcuccugguggcgaauuuaccguuucaccaaggaacgcacccggggagauccuuuggagugccccucugggaccagacuugaaucccuacuuaagccaccuggcucggauguauaacggcuacgccgguggguucgaagugcaggucauucuagcgggaaaugcauuuacagccggcaaagugaucuucgcugccguaccuccaaacuuuccgacugagggccucucccccucucagguuacgauguucccucauauuguggucgaugugcgccaacuggagccagugcuuaucccccugccugacguccgaaauaacuuuuaucacuacaaucagucgaacgauccaaccauaaaguugaucgcaaugcucuauacaccccugcgugcuaacaaugccggggacgauguuuucacugugucaugcagaguacugaccaggccgagcccugacuuugauuucauuuuucucgugcccccaacagucgaaagucggaccaaaccuuucuccgugcccguuuuaacuguggaggaaaugacaaacucucgcuuuccaaucccccuggagaaacuuuucaccggaccuagcuccgcguucgucgugcagccacagaaugguagauguacgacugacggcguauugcuggggaccacacaacuaucaccgguuaacauuugcacuuuuaggggagaugugacccauaucacaggcagucggaauuacaccaugaaccucgccagccagaauuggaacaauuaugaccccacggaggaaauaccugcaccacuggguacucccgacuucgucgggaagauucagggagugcuuacacagaccacucgcacagauggcucuacccgaggccacaaggcuacggucuacaccggguccgccgacuuugcuccuaagcugggaagagugcaauucgagacagauacugaccaugauuuugaagccaaccagaauaccaaauucacaccaguuggugugauccaggacggcgggacuacccacaggaacgagccccaacaguggguauugccgucauacagcggacgggauacacacaauguccaucucgccccugcaguggcuccaaccuuucccggcgaacagcuguuauucuuucguaguacuaugccugguuguucuggguaucccaacauggaccuggauugccuccuuccacaggaguggguucaauacuucuaucaggaggcggccccugcacaguccgacguggcucuguugcgcuuugucaaucccgauacgggcagagugcuauucgaauguaagcugcacaaaagcggauacguaacaguggcccauaccggccagcacgaccucguuauuccaccgaacggguauuuuagguucgacucgugggucaacaaguucuacacucuggcaccuaugggaaaugguaccggccggcgacgcuga

SEQ ID NO: 21163 - RNA, 1617 nt, Artificial Sequence
  derived and/or modified sequence opt3 from VP1__Norovirus_and/or_Norovirus-like__KT202795
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcgggacuacccaucggaacgagccccaacaguggguauugccgaguuacucuggacguaauauuccuaacguccaccucgccccagcuguggcgcccacauuuccuggcgaacagcuguuauucuuucgcuccaccaugcccgguuguagcggguauccaaauauggaccuggauugccuccuuccucaggaguggguucaauacuucuaucaggaggcagcccccgcucagucggacguggcccuguugagauuugucaacccagauacuggcagggugcuauucgaauguaagcugcacaaaucuggauacguaacgguggcacauacaggccagcacgaccucguuaucccgccuaauggguauuuucgguucgauuccugggucaaccaauucuacacccuggcccccaugggaaacgguacuggccgacgcagauga

SEQ ID NO: 21164 - RNA, 1617 nt, Artificial Sequence
  derived and/or modified sequence opt3 from VP1__Norovirus_and/or_Norovirus-like__AB933742
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaucaggcuacgucacaguggcucauaccggacagcacgaucucguaauuccucccaacggcuauuuuagguucgacaguuggauaaaucaauucuacacucuggccccaauggggaacggaaccggucggcgacgcuga

SEQ ID NO: 21165 - RNA, 1617 nt, Artificial Sequence
  derived and/or modified sequence opt3 from VP1__Norovirus_and/or_Norovirus-like__AB933722
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucgggccaaaccauucaccgugccuaucuuaacugucgaagagaugacaaauagccgcuuucccauaccacuggagaaacuuuucaccggacccuccucagcauucgugguucagccucagaacgguagauguacgacugacggcguguugcuggggaccacacaacuaaguccagucaauauuugcacuuuuaggggagaugugacccauaucgcuggcagccggaacuacacaaugaaucucgccucuccgaacuggaauaacuaugaccccaccgaagagauuccugcuccacuggguacgcccgauuucguagggaagauccagggaaugcuuacucagacaaccaagggcgacggcuccacucgcgggcacaaggccacaguuuacaccggaucagcaccuuuuacgccaaaacuggguagcgugcaguucaguaccgacacagaaaaugauuuugagacucaucaaaacaccaaguucacacccgucggcgugauccaggacgggucuacuacccaccgaaaugaaccgcagcaaugggucuugccuuccuacagcggaagaaacgugccaaauguucaccucgcccccgcuguggcgccuacauuucccggcgagcagcuguuauucuuuaggucgaccaugccagguuguucuggguauccuaacauggaucuggacugccuccuuccccaggaguggguacagcauuucuaccaagaagcagccccagcucaguccgaugucgcccuguugcgguuugugaauccggacacuggccguguucuauucgaguguaaacugcacaagucaggauaugugacggucgcacauacaggccagcacgaucucgugauuccucccaacggguacuuucgcuucgacaguuggguaaaccaguucuauacccuggccccaaugggaaaugguacuggcagaaggcgguga

SEQ ID NO: 21166 - RNA, 1617 nt, Artificial Sequence
  derived and/or modified sequence opt3 from VP1__Norovirus_and/or_Norovirus-like__KJ678138
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaucgggagugcugauuuugccccuaagcugggaagagugcaauucgagaccgacacagaucaugacuuugaagcaaaucagaacacuaaauucaccccaguuggugugauucaggauggcucuacaacucacaggaaugagccccaacaguggguauugccguccuacagcgggcggaacaccccuaauguccaccucgccccagcuguggcgcccacauuuccuggagaacagcuguuauucuuucguucgaccaugcccggcuguucugguuauccaaacauggaccuggauugccuccuuccucaggaguggguucaauacuucuaucaggaggcagcccccgcucaguccgacguggcccuguugcgcuuugucaauccagauacugggagagugcuauucgaauguaagcugcauaaaucaggcuacguaacgguggcacacacaggacagcaugaccucguuaucccgccuaacggcuauuuuagguucgauaguugggucaaucaauucuacacccuggcccccauggggaacggaacuggucggcgacgcuga

SEQ ID NO: 21167 - RNA, 1617 nt, Artificial Sequence
  derived and/or modified sequence opt3 from VP1__Norovirus_and/or_Norovirus-like__KP244317
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcacgucucuauacuccccugagagcuaauaacgccggggaugacguguucaccgucaguugcaggguucugacacggccguccccugauuuugacuucauuuuucucgugcccccaaccguagaaucucgcacuaaaccuuucagcgugcccgucuuaacaguggaggaaaugaccaacuccagauuuccaaucccccuggagaaacuuuucacgggaccuucaagugcguucguugugcagccacagaaugguagguguacuaccgauggcgucuugcuggggacaacucaacuaagcccggugaacauaugcaccuuucggggagacguaacacauauuucuggcucccgcaauuacaccaugaaccucgccucacagaauuggaacagcuaugaucccacggaggaaaucccugcaccacuggguacucccgacuucguugggaagauucagggagugcuuacacagaccacuaagacaaauggcaguacccgaggccacaaggcuacggucuacaccgggucugccgacuuuuccccuaaacugggaagagugcaauucgcuacagauacugacaacgauuuugagaccaaucagaacacaaaguucacuccagucggugugauccaggacggcagcaccacacccaggaaugaaccgcaacaguggguuuugccuucguacucugggcggaacacccauaaugugcaccucgccccagcaguagcccccacuuuuccuggagagcagcuguuauucuuucguuccacgaugcccggcuguucagguuauccaaacauggaucuggacugccuccuuccucaggaauggguccaauacuucuaucaggaggcugcgcccgcacagagugauguggcccuguugcgcuuuguuaauccagacacagggagagugcuauucgaguguaaacugcacaagagcggcuacgucaccguggcucauacuggacagcacgaucucguaaucccgccuaacggcuauuuuagguucgacuccugggugaaccaauuccauacccuggcccccauggggaauggaacaggucggcgacgcuga

SEQ ID NO: 21168 - RNA, 1617 nt, Artificial Sequence
  derived and/or modified sequence opt3 from VP1__Norovirus_and/or_Norovirus-like__KP698925
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaaaccaaccagaauacaaaauucacuccaguuggugugauccaggauggcaguaccacacacaggaacgagccccaacaguggguauugccgucuuacuccgggcggaauaccccuaacguccaccucgcaccagccguggcucccacuuuuccuggagaacagcuguuauucuuucguagcacgaugcccggcuguucggguuauccaaauauggaccuggauugccuccuuccucaggaguggguucaauaccuguaucaggaggcggcacccgcccagucugacguggcuuugcuacgcuucgucaacccagauacagggagagugcuguuugaauguaagcuccauaaauccggcuacguaaccguggcccacacuggacagcaugaccugguuauuccgccuaauggcuauuucagguuugauucaugggucaaccaauucuacacccuugcacccauggggaacggaacaggucggcgacgcuga

SEQ ID NO: 21169 - RNA, 1617 nt, Artificial Sequence
  derived and/or modified sequence opt3 from VP1__Norovirus_and/or_Norovirus-like__LC005727
augaagauggccagcuccgacgcuaaucccccugauggcucugcagccaaccuggugccagaggucaacaaugaaguuauggcgcucgagccggugguaggggcugccaucgcagcccccguggcuggacagcaaaacgucauugacccuuggauaagaaauaacuucgugcaggcaccagguggcgaauuuaccguuucacccaggaaugccccuggggagauccuuuggagugcuccacugggacccgauuugaacccuuacuuaagccaccuggcccggauguauaauggcuacgcggguggguucgaagugcaggucauucuagcaggaaacgccuuuacagcuggcaaagugaucuucgccgcaguaccaccgaauuuucccacugagggccucuccccuucucagguuacgauguucccacauauuguggucgacgugcgccaacuggagcccgugcuuaucccucugccagauguccgaaacaauuuuuaucacuacaaccagucgaaugaccccaccauaaaguugaucgcuaugcucuauacaccgcugcgugccaacaacgcgggggaugacguuuucacugugucaugcagaguacugaccaggccuagccccgauuuugacuucauuuuucucgugccaccuacagucgaaagucggaccaaacccuucuccgugccaguuuuaacuguggaggaaaugacaaauucucgcuuucccaucccucuggagaaacuuuucaccggaccaagcuccgccuucgucgugcagccgcagaacgguagauguacgacugauggcguauugcuggggaccacacaacuaucacccguuaauauuugcacuuuuaggggagacgugacccauaucacaggcagucacaacuacaccaugaaucucgcaagccagaacuggaauaacuaugauccuacggaggaaauaccagcuccccuggguacuccugacuucgucgggaagauucagggagugcuuacacagaccacucggacagacggcucuacccgcggccauaaggccacggucuacaccggguccgcugauuuugccccaaagcugggacgagugcaauucgagacagacacuaaucacgauuuugaagcaaaccagaauaccaaauucacacccguuggugugauccaggacggcgggacuacccacagaaacgagccgcaacaguggguauugccuucauacagcggaaggaauacacauaacguccaccucgccccagcuguggcgcccaccuuuccuggcgaacagcuguuauucuuucggaguacuaugcccgguuguucuggguauccaaauauggaucuggacugccuccuuccucaggaguggguucaauacuucuaucaggaggcagcccccgcucaguccgauguggcccuguugcguuuugucaacccagacacgggccgcgugcuauucgaauguaagcugcauaaaagcggauacguaacaguggcacacaccggccagcacgaucucguuauuccgccuaacggguauuuuagauucgacucgugggucaaucaauucuacacucuggcccccaugggaaacgguaccggcaggcggcgauga

SEQ ID NO: 21170 - RNA, 1617 nt, Artificial Sequence
  derived and/or modified sequence opt3 from VP1__Norovirus_and/or_Norovirus-like__LC016603
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcacgucuacuuaccggaugaaccucgccucccagaauuggaacaauuaugauccgacagaggaaauucccgcaccucuggguaccccagacuucguagggaagauccagggaaugcuuacucagacaaccaagggcgacggcucaacgcgcgggcacaaggcuaccguuagcacaggaaguguggauuuuacucccaaacuggguucuguccaauucgccaccgacacagauaacgacuuugagacuggccagaauacccgauucacaccugugggggucauccaggauggauccggcgcucauagaaacgaaccacaacaguggguguugcccgacuacagcgguaagaccguucacaaugugcaccucgccccggcaguagccccuacuuuuccaggggagcagcuguuauucuuuaggucgacgaugcccggcuguucuggauacccuaacauggaucuggacugccuccuuccccaggaauggguccaacauuucuaucaggaggcugcgccagcacaguccgauguggcccuguugcgguuuguuaauccugacacaggccgugugcuauucgaguguaaacugcacaagaccggguacgucacuguggcucauaccggacagcacgaucucguaauucccccaaacgguuauuuucgcuucgacucaugggugaaucaauucuacacacuggccccgaugggcaacggggcaggaagaaggcgguga

SEQ ID NO: 21171 - RNA, 1617 nt, Artificial Sequence
  derived and/or modified sequence opt3 from VP1__Norovirus_and/or_Norovirus-like__LC016599
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgagcacgcggacuuaccgcaugaaccucgccucucagaauuggaacaauuaugaucccacagaggaaauuccugcaccacugggcacccccgacuucguagguaagauccaggggaugcuuacucagacaaccaagggagacggcuccacgcgaggccacaaggcuaccguuucaacagggagcguggauuuuacuccuaaacugggaaguguccaauucgccaccgacacagauaacgacuuugagacuggucagaauaccagauucacaccagugggcgucauccaggaugggucuuccgcucauaggaacgaaccccaacaguggguguugccggacuacagcggacggaccguucacaaugugcaccucgccccugcaguagccccaacuuuucccggcgagcagcuguuauucuuucguucgacgaugccugguuguucuggguaccccaacauggaucuggacugccuccuuccacaggaauggguccaacauuucuaucaggaggcugcgccugcacaguccgauguggcccuguugcgcuuuguuaaucccgacacaggcagagugcuauucgaguguaagcugcacaaaaccggauacgucacuguggcucauaccggccagcacgaucucguaauuccaccgaacggguauuuuagguucgacucaugggugaaucaauucuacacacuggccccuaugggaaacggugcaggccggcgacgcuga

SEQ ID NO: 21172 - RNA, 1617 nt, Artificial Sequence
  derived and/or modified sequence opt3 from VP1__Norovirus_and/or_Norovirus-like__KP293587
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacugaagccagugcuuaucccccugccugauguccgaaacaauuuuuaucacuacaaccagucaaaugacccaaccauaaaauugaucgcuaugcucuauacaccccugcgugccaacaacgcgggggaugacguuuucacugugagcugcagaguacugaccaggccgaguccugauuuugacuucauuuuucucgugcccccaacagucgagucccggaccaagccuuucucugugcccguuuuaacuguggaagagaugacaaauagccgcuuuccaaucccccuggaaaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacucuuacaccaugaaccucgcaucccagaauuggucaaacuaugaucccacggaggagauaccugcuccacuggguacucccgacuucgucgggaagauucagggagugcuuacacagaccacucggacagacggcagcacccgcggccauaaggccacggucuacaccgggagugcugauuuugccccuaaacugggacgagugcaauucgaaacagacacuaaucacgauuuugaggcaaaccagaauaccaaguucacaccaguuggugugauccaggacggcucuacuacccacagaaacgaaccccaacaguggguauugccguccuacagcgggaggaauacaccuaacguccaucucgccccagcuguggcgcccaccuuuccuggagagcagcuguuauucuuucggucgacuaugcccggcuguucugguuauccaaauauggaucuggacugccuccuuccucaggaauggguucaauacuucuaucaggaggcagcccccgcucaguccgauguggcccuguugcguuuugucaacccagacacggggcgcgugcuauucgaguguaaacugcacaagucaggcuacguaacaguggcacauaccggacagcacgaucucguuauuccgccuaauggcuauuuuagauucgacaguugggucaaccaauucuacacucuggcccccaugaggaacgggaccggacggcgacgcuga

SEQ ID NO: 21173 - RNA, 1617 nt, Artificial Sequence
  derived and/or modified sequence opt3 from VP1__Norovirus_and/or_Norovirus-like__KP176402
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaaccuugugcaggcaccugguggcgaguucaccguuaguccaaggaaugcccccggggaaauccuguggagcgcuccuuugggaccagaauuaaaccccuaccugucccaccuagcccggauguauaauggcuacgcggguggguuugaggugcaggucauucucgcaggaaacgccuucacagcuggcaaagugaucuuugccgcaguaccuccaaauuucccgacugagggccugucucccucgcagguuacgauguuuccucauauuguggucgaugugcgccaacuugaaccagugcugauccccuugccugacguccgaaacaauuucuaucacuacaaccagucaaaugauccaaccauaaagcucaucgcuaugcuguauacaccccugcgugccaacaacgcgggggacgauguuuuuacugugagcugcagaguacucaccaggccgaguccugacuucgauuuuauuuucuuagugcccccaacagucgagucccggaccaaaccuuuuucugugcccguucugacuguggaagagaugacaaauagccgcuucccaaucccccuugagaaguuguuuaccggaccuuccucagccuucgucgugcagccacagaacgguagauguacgacugacggcguacugcuagggaccacacaacucaguccgguuaauauuugcacuuucaggggagaugugacccauaucacaggcagccggaacuacaccaugaaucuggcaucucagaacugguccaauuaugaccccacggaagagauaccugcuccacuugguacucccgauuuugucgggaaaauucagggagugcugacacagaccacucgcacagacggcucaacccgaggccacaaggccacggucuacaccgggagcgcugacuucgccccuaaguugggaagagugcaauuugaaacagauacugacagggauuucgaggcaaaccagaauaccaaauuuacaccaguuggugugauccaggacggcaguacuacccaucggaacgaaccccaacaguggguacucccgucuuacuccgggcguaauacaccuaacguccaccuggccccagcuguggcgcccaccuucccuggagagcaguuacuguuuuuccgcagcacuaugcccggcuguucggguuauccaaauauggaucucgacugccuucugccucaggaguggguucaauacuuuuaucaggaagcagcccccgcucagucugauguggccuugcuaagauucgucaacccagacacggggagggugcuguuugaguguaagcuccacaaauccggcuacguaacaguggcacauaccggacagcacgaucugguuauuccgccuaauggcuauuuccgguuugacucaugggucaaccaauucuacacucuugcccccauggggaacggaaccggucgacgcagauga

SEQ ID NO: 21174 - RNA, 1617 nt, Artificial Sequence
  derived and/or modified sequence opt3 from VP1__Norovirus_and/or_Norovirus-like__KJ196287
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggccaugccgguggguucgaagugcaggucauucuagcgggaaacgcauuuacugccggcaaaaucauuuucgcugccgugccuccaaauuuuccgacggagggccucucucccucgcagguaaccauguucccucacaucauaguugacgugcgccaacuggagccaguccuuaucccccugccugaugugcgaaacaauuuuuaccauuauaaccagucaaaugacagcacaauuaaguugaucgcaaugcucuacacuccacugcgugcuaacaacgccggggaagauguguucaccgucaguugcagaguucugacaaggcccuccccggacuuugauuucauuuuucucgugccucccaccguagagucucggacuaaaccauucacagugccuaucuuaaccgucgaagagaugacgaauagccgcuuucccauaccacuggagaaacuuuucacuggacccuccucagcguucgugguucagccucagaacgguagauguaccacagacggcguguugcuggggacuacccaacuaaguccagucaauauuugcacauuuaggggagaugugacccacaucgccggcagccggaacuauacgaugaaucucgcaucucugaacuggaauaacuacgacccgacugaagagauucccgcuccucuugguacaccagauuucguagggaagauccagggaguucugacccagacuacaaagggcgacggcuccacccgcgggcauaaggccacgguguauaccggaucagcucccuuuacaccuaaauuggguagcguccaguucaguacugacaccgaaaaugauuuugagacacaccaaaacacuaaguucaccccagugggcgucauccaggacgggggaacaacccaccgaaaugaaccccagcaaugggugcucccgucuuacuccggcagaaacguucauaaugugcaccuggccccugcaguagccccaacuuuucccggugagcaguuacuguucuuuaggagcacgaugccuggguguucgggcuaccccaacauggaucucgacugccuucugccacaggaguggguccagcauuucuaucaagaagcugcgccugcacagucugauguggccuugcuacgguuuguuaaucccgacacaggacgugugcuguucgaguguaaacuccacaaguccggcuacgucaccguggcucacacugggcagcaugaucugguaauuccaccgaacggauauuuucgcuucgacucaugggugaaccaguucuacacccuugccccuauggguaauggcacagggagaaggcgguga

SEQ ID NO: 21175 - RNA, 1617 nt, Artificial Sequence
  derived and/or modified sequence opt3 from VP1__Norovirus_and/or_Norovirus-like__KM198480
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagagauguucacaacgugcaucuggccccugcaguagcuccaacuuuucccggggagcaguuacuguucuuuaggucuacgaugccuggcuguuccggauaucccaauauggaccucgauugccuucugccacaggaguggguccagcacuucuaccaagaagcggccccugcacagagcgacguggcuuugcuacgguuuguuaaccccgauacaggccgugugcuguucgaguguaaacucuauaagucgggguacgucaccguggcccauacuggacagcacgaccugguaauuccaccgaaugguuauuuucgcuucgauucuugggugaaccaguucuacacccuugcaccuaugggcaacgggacaggaagaaggcgguga

SEQ ID NO: 21176 - RNA, 1617 nt, Artificial Sequence
  derived and/or modified sequence opt3 from VP1__Norovirus_and/or_Norovirus-like__KJ716357
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggccaugcggguggguucgaagugcaggucauucuagcaggaaacgccuuuacagcuggcaaagugaucuucgccgcaguaccuccaaauuuuccgacugagggccucucucccucgcagguuacgauguucccucacauuguggucgacgugcgccaacuggagccagugcuuaucccccugccugauguccgaaacaauuuuuaccauuauaaccagucaaaugacccaaccauaaaguugaucgcuaugcucuacacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccacaucacaggcagccggaacuauaccaugaaucucgcaucucagaacuggaauaacuacgaucccacggaggaaauaccugcuccacuggguacucccgacuucgucgggaagauucagggagugcuuacacagaccacucgcacagacggcuccacccgaggccauaaggccacggucuauaccgggucagcugauuuugccccuaagcugggaagagugcaauucgagacagacacugaucacgacuuugaagcaaaucagaacaccaaauucacaccaguuggugugauccaggauggcgggacuacccacaggaaugagccccaacaguggguauugccgagcuacaguggacggaacacacauaauguccaccucgccccugcuguggcgccaaccuuucccggcgaacagcuguuauucuuucguucuacuaugccugguuguuccggguaccccaacauggaccuggauugccuccuuccacaggaguggguucaauauuucuaccaggaggcagccccugcucagagcgacguggcccuguugcgcuuugucaaucccgauacgggcagagugcuauucgaauguaagcugcauaaaucgggauauguaacaguggcacacaccggccagcacgaccucguuauuccaccgaacggguacuuuagguucgauucuugggucaaccaauucuauacucuggccccuaugggaaaugguaccggccggcgacgcuga

SEQ ID NO: 21177 - RNA, 1617 nt, Artificial Sequence
  derived and/or modified sequence opt3 from VP1__Norovirus_and/or_Norovirus-like__KJ716354
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaucgggucagcugauuuugccccuaagcugggaagagugcaauucgagaccgacacagaucaugacuuugaagcaaaucagaacacuaaauucaccccaguuggugugauucaggauggcgggacaacucacaggaaugagccccaacaguggguauugccgagcuacaguggacggaacacccacaauguccaucucgccccugcuguggcgccaacauuucccggcgaacagcuguuauucuuucguucuaccaugccugguuguuccggguaucccaacauggaccuggauugccuccuuccacaggaguggguucaauacuucuaucaggaggcagccccugcucagagcgacguggcccuguugcgcuuugucaaucccgauacuggcagagugcuauucgaauguaagcugcacaaaucgggauacguaacgguggcacauacaggccagcacgaccucguuaucccaccgaacggguauuuuagguucgauucuugggucaaccaauucuacacccuggccccuaugggaaaugguacuggccggcgacgcuga

SEQ ID NO: 21178 - RNA, 1617 nt, Artificial Sequence
  derived and/or modified sequence opt3 from VP1__Norovirus_and/or_Norovirus-like__KJ685403
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucacaacugacaccgauaaugacuuugucacaaaucagaacacuaaauucaccccaguggguguuauccaggauggcuccacaacccccaggaaugagccgcaacaguggguguugccuagcuacucggggcggaacacucauaauguacaccucgcuccagccgucgcacccacguuuccuggagaacagcuguuauucuuucguucuacaaugcccggcuguuccgguuauccaaacauggaccuggauugccuccuuccucaggagugggugcaauacuucuaucaggaagccgcucccgcgcagucagacguugcacuguugcgcuuugugaauccagauaccgggagaguccuauucgaguguaagcugcacaaaaguggcuacgugacuguagcccauaccggacagcacgaccucgugaucccgccuaacggcuauuuuagguucgauagcuggguuaaccaauucuacacacuggcucccauggggaauggaaccggucggcgacgcuga

SEQ ID NO: 21179 - RNA, 1617 nt, Artificial Sequence
  derived and/or modified sequence opt3 from VP1__Norovirus_and/or_Norovirus-like__KF060108
augaagauggccagcuccgacgcuaaccccucugauggcucaagugcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuaccguuagcccaaggaaugcacccggggagauccuuugguccgccccucugggaccagauuugaaccccuacuuaucucaccuggcucggauguauaauggcuacgccgguggguucgaagugcaggucauucuagcgggaaacgcauuuacagccggcaaaaucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccagagcaaugacccaaccauuaaguugaucgcaaugcucuauacaccccugcgugcuaacaacgccggggaugacguguucacugucaguugcagaguucugaccaggccguccccugauuuugacuucauuuuucucgugcccccaacaguagaaucucggaccaaaccuuucagcgugcccgucuuaacuguggaggaaaugacaaauucccgcuuuccaaucccccuggagaaacuuuucaccggaccuucaagugcguucguugugcagccacagaacgguagauguacgacugauggcgucuugcuggggaccacacaacuaagcccggugaauauaugcacuuuuaggggagacguaacccauauuucuggcucccggaacuacacaaugaaucucgccucacagaacuggaauagcuaugaucccaccgaggaaaucccugcaccacuggguacgcccgacuucguugggaagauucagggagugcuuacucagacaacccgcacugacggcaguacacgaggccacaaggcuaccgucuacacggggucugccgauuuuuccccuaagcugggaagagugcaauucgcuaccgacacagauaacgacuuugucacuaaucagaacaccaaauucacaccaguggguguuauccaggauggcagcacuacccccaggaaugagccgcaacaguggguguugccuucguacucugggcggaacacacauaauguacaccucgccccagcagucgcccccaccuuuccuggagaacagcuguuauucuuucguuccacuaugcccggcuguucagguuauccaaacauggaccuggauugccuccuuccucaggagugggugcaauacuucuaucaggaagcugcgcccgcacagagugacguugcccuguugcgcuuugugaauccagauacggggagaguccuauucgaguguaagcugcacaaaagcggcuacgugacaguagcucauaccggacagcacgaccucgugaucccgccuaacggcuauuuuagguucgauuccuggguuaaccaauucuacacucuggcccccauggggaauggaaccggucggaagcgauga

SEQ ID NO: 21180 - RNA, 1617 nt, Artificial Sequence
  derived and/or modified sequence opt3 from VP1__Norovirus_and/or_Norovirus-like__KF060099
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacagacggcucaacccgaggccacaaggcuacggucuacaccgggagcgccgauuuuaguccaaagcugggaagagugcaauucgcuacagacacugauaaugacuuugucaccaaucagaacacaaaauucacucccguggguguuauccaggauggcucuaccacaccgaggaaugagccucaacaguggguguugccauccuacagcgggcggaacacccauaauguacaccucgcccccgcagucgccccuacuuuucccggagaacagcuguuauucuuucguucgacgaugccaggcuguucugguuauccuaacauggaccuggauugccuccuuccccaggagugggugcaauacuucuaucaggaagcugcgccagcacaguccgacguugcccuguugcgcuuugugaauccggauacagggagaguccuauucgaguguaagcugcacaaaucaggcuacgugaccguagcucauacuggacagcacgaccucgugaucccucccaacggcuauuuuagguucgauaguuggguuaaccaauucuacacccuggccccaauggggaauggaacaggucggcgacgcuga

SEQ ID NO: 21181 - RNA, 1617 nt, Artificial Sequence
  derived and/or modified sequence opt3 from VP1__Norovirus_and/or_Norovirus-like__KF060004
augaagauggccagcuccgacgcuaaccccucugauggcucaguggcaaaucuggucccugagguuaacaaugaagugauggcccucgagccaguagugggggcggcuaucgccgcaccggucgccggacagcaaaacgugauugaccccuggauaagaaauaacuucguucaggcuccugguggcgaauuuaccgugaguccaaggaaugcacccggggagauccuuuggagcgccccucugggaccagauuugaaccccuacuuaucccaccuggcucggauguauaauggcuacgccgguggguucgaaguccaggugauucuagcgggaaacgcauuuacagccggcaaaguaaucuucgcugccguuccuccaaauuuuccgacugagggccucucucccucacaggugacgauguucccucauauugucguggacgugcgccaacuggagccaguccuuaucccccugccugauguucgaaacaauuuuuaucacuacaaccagucgaaugacccaaccauaaaguugaucgcaaugcucuauacaccccugcgugcuaacaacgccggggaugacguguucacuguaagcugcagagugcugaccaggccgaguccugauuuugacuucauuuuucucgucccuccaacaguggaaucccggaccaaaccuuucucuguucccguguuaacugucgaggaaaugacaaauagccgcuuuccaaucccccuggagaaacuuuucaccggaccuuccucagcguucgugguacagccacagaacgguagauguacgacugauggcguuuugcuggggaccacacaacuaaguccggugaauauuugcacuuuuaggggagacgucacccauaucacaggcagccggaacuacaccaugaaucucgccucucagaacuggaauaacuaugaucccacggaggaaauaccugcaccacuggguacucccgacuucguggggaagauucagggaguccuuacacagaccacucgcacagacggcuccacccgaggccacaaggcuacgguguacaccgggucagccgauuuugcuccuaagcugggaagaguucaauucgagacagacacugaucaugacuuugaagccaaucagaacaccaaauucacaccaguggguguaauccaggauggcgggacuacccacaggaaugagccccaacagugggucuugccgagcuacaguggacggaacacacacaaugugcaucucgcacccgccguugcuccaaccuuucccggcgaacagcuguuauucuuucguucuacuaugccugguuguuccggguaucccaacauggaccuggauugccuccuuccacaggagugggugcaauacuucuaucaggaggcggccccugcacagagcgacgucgcucuguugcgcuuugugaaucccgauacgggcagaguacuauucgaauguaagcugcacaaaucgggauacgugacaguugcccauaccggccagcacgaccucgucauuccaccgaacggguauuuuagguucgauucuugggugaaccaauucuacacucuggcaccuaugggaaaugguaccggccggcgacgcuga

SEQ ID NO: 21182 - RNA, 1617 nt, Artificial Sequence
  derived and/or modified sequence opt3 from VP1__Norovirus_and/or_Norovirus-like__KF060006
augaagauggccagcuccgacgcuaaccccucugauggcucaaccgcaagucuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuagcccaaggaacgcacccggggagauccuuugguccgccccucugggaccagauuugaaucccuacuuaucucaccuggcucggauguauaacucguacgccggcgguuucgaagugcaggucauucuagcggggaaugcauuuacugccggaaaaaucauuuucgcugccgugccuccaaacuuuccgacggagggccucucacccagccagguaaccauguucccucauaucauaguugacgugcgccaacuggagccaguccuuaucccccugccugaugugcgaaauaacuuuuaucacuacaaucagaguaacgacccaacaauuaaguugaucgcaaugcucuauacuccccugcgugcuaauaacgccggcgaugacguguucaccgucuccugcagaguucugacaaggccgucuccugauuuugacuucauuuuucucgugcccccaaccguagaaagccggacuaaaccuuucuccgugcccgucuuaacaguggaggaaaugaccaacucacgcuuuccaaucccccuggagaaacuuuucacggggccuaguagcgcguucguugugcagccacagaauggaagauguacuaccgauggugucuugcugggcacaacucaacuaucuccggugaacauaugcaccuuuaggggagacguaacacauauuuccgggucacacaauuacaccaugaaccucgccagccagaauuggaacaguuaugaucccacggaggaaaucccugcaccacugggcacucccgacuucguugguaagauucagggggugcuuacacagaccacucggaucaauggaucuacacgcggccauaaggcuaccgucuacacgggcuccgccgacuuuagcccuaagcuggggcgagugcaauucgcuaccgauacagacaacgauuuugagacuaaucagaacaccaaauucacaccagucggagugauccaggacgguucgacuacccccagaaaugaaccgcaacaguggguuuugccuucuuacuccggcaggaacacacacaaugugcaccucgccccagcaguagcccccaccuuuccuggggagcagcuguuauucuuucggucaacuaugcccggauguaguggcuauccaaacauggaucuggacugccuccuuccucaggaauggguccaauacuucuaucaggaggcugcgcccgcacagagcgauguggcccuguugcguuuuguuaauccagacacgggucgcgugcuauucgaguguaagcugcauaaauccggguacgucacaguggcucacaccggccagcaugaucucguaauuccgccuaacggauauuuuagauucgacucuugggugaaccaauucuacacucuggcccccaugggcaaugggaccggaaggcggcgauga

SEQ ID NO: 21183 - RNA, 1617 nt, Artificial Sequence
  derived and/or modified sequence opt3 from VP1__Norovirus_and/or_Norovirus-like__KC517371
augaagauggccagcaacgacgcuaaucccuccgauggcucugcagccaaccuggugccugaggucgacaaugaaguuauggcgcucgagccagugguaggggcugccaucgcagccccgguggcuggacagcaaaacgucauugaucccuggauaagaaauaacuucgugcaggcaccugguggcgaauuuaccguuucaccaaggaaugcccccggggagauccuuuggagugcuccucugggaccagacuugaaccccuacuuaagccaccuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucauaucauaguugaugugcgccaacuggagccaguccuuaucccccugccugacgugcgaaacaauuuuuaucacuacaaccagucgaaugauucaaccauuaaguugaucgcuaugcucuauacaccacugcgugccaacaacgcgggggaagacguguucacugucagcugcagaguucugaccaggcccaguccggauuuugacuucauuuuucucgccccucccacaguggagucccggaccaaaccauucacuguaccuaucuuaacaguggaagagaugaccaauucucgcuuucccauaccacuggagaaacuuuucacgggacccagcuccgcauucgucgugcagccucagaacgguagauguacuaccgauggcguuuugcuggggacaacucaacuaucaccagugaauauuugcaccuuuaggggagacgucacacauaucgcuggcagucggaacuacaccaugaaucucgccagccugaacuggaauaacuaugauccgacggaagagauucccgcuccucuugguacuccagacuucguggggaagauccagggaaugcugacacagaccacuaagggcgacggcucuacacgcgggcacaaggccaccguauacacgggauccgcacccuuuaccccuaaauuggguucaguucaguucgaaacagauacugagaaugacuuugaaacccaucaaaacacaaaguucacuccagugggcgucauccaggaugggggaaccacacaccgaaaugagccccagcaaugggugcucccgagcuacaguggcagaaacgucccuaaugugcaccuggccccagcuguugcgcccaccuuuccuggugagcaguuacuguucuuuaggucuacuaugcccggguguuccggcuauccaaacauggaccucgauugccuucugccucaggaaugggugcagcauuucuaccaagaggcagcccccgcucagagcgacguagccuugcuacgguuugucaauccagauacgggacgugugcuguucgaauguaaacuccacaagucgggcuauguuacaguggcacauaccgggcagcacgaccuggucauuccgccuaacggauacuuucgcuucgauucuugggugaaccaguucuauacucuugcccccauggguaauggcaccgggagaaggcgguga

SEQ ID NO: 21184 - RNA, 1617 nt, Artificial Sequence
  derived and/or modified sequence opt3 from VP1__Norovirus_and/or_Norovirus-like__JX459657
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucguuguggacguccgccaacuggagccagugcuuauaccccugccugaugugcgaaauaacuuuuaucauuacaaucagucaaacgacccaacaaucaaguugauugcaaugcucuauacuccccugcgugcuaauaacgccggggaugacgucuucaccguuagcugcagagugcugacaaggccgaguccugauuuugacuucaucuuucucguacccccaaccguggaaucccggacuaaaccuuucucuguccccguguuaacaguugaggaaaugaccaacagccgcuuuccaauuccccuggagaaacuuuucacgggaccuuccucagcguucgugguccagccacagaaugguagauguacuaccgauggcguguugcuggggacaacucaacuaaguccgguaaacaucugcaccuuuaggggagacguuacacacauaagcggcucucggaauuacaccaugaaccucgccucccagaauuggaacucauaugaucccacggaggaaauuccugcaccacuggguacucccgacuucguggggaagauccagggaguccuuacacagaccacucgcacagacggcagcacccgaggccauaaggcuacgguguacaccgggagugccgauuuuucuccuaagcugggaagaguccaauucgcuacagacacugauaaugacuuugugaccaaccagaauacaaaauucacuccaguuggugugauucaggauggcuccaccacacccaggaacgagccgcaacaguggguauugccuagcuacucggggcggaauacccacaacguccaccucgccccagcaguggcccccacuuuuccuggagaacagcuguuauucuuucguucuacgaugcccggcuguuccgguuauccaaauauggaccuggauugccuccuuccucaggaguggguucaauacuucuaucaggaagcugcgcccgcacagucagacguggcccuguugcgcuuugucaacccagauacagggagagugcuauucgaguguaagcugcauaaaaguggcuacguaaccguggcucacacuggacagcaugaccucguuaucccgccuaauggcuauuuuagguucgauagcugggucaaccaauucuacacccuggcccccauggggaacggaacaggucggcgacgcuga

SEQ ID NO: 21185 - RNA, 1617 nt, Artificial Sequence
  derived and/or modified sequence opt3 from VP1__Norovirus_and/or_Norovirus-like__JX459656
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucauaguugacgugcgccaacuggagccaguccuuaucccccugccugaugugcgaaauaacuuuuaucauuacaaucagucaaacgacccaacaauuaaguugaucgcaaugcucuauacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacacauucccggcagccggaauuacaccaugaaccucgccucucagaauuggaacuccuaugauccuacggaggaaaucccagcaccccuggguacuccugacuucguugggaagauucagggagugcuuacacagaccacucgcacaaauggcucaacccgaggccauaaggcuacggucuacaccgggagcgccgacuuuaguccaaagcugggaagagugcaauucgcuacagauacugacaacgauuuugagaccaaucagaacacaaaauucacucccgucggugugauccaggacggcucuaccacaccgaggaaugaaccucaacaguggguuuugccauccuacagcgggcggaacauccacaaugugcaccucgcccccgcaguagccccuaccuuucccggagagcagcuguuauucuuucguucgacuaugccaggcuguucugguuauccuaacauggaucuggacugccuccuuccccaggaauggguccaauacuucuaucaggaggcugcgccagcacaguccgauguggcccuguugcgcuuuguuaauccggacacggggagagugcuauucgaguguaagcugcauaaaucaggcuacgucacaguggcucacaccggacagcaugaucucguaauuccucccaacggcuauuuuagguucgacaguugggugaaccaauucuacacucuggccccaauggggaauggaaccggucggcgacgcuga

SEQ ID NO: 21186 - RNA, 1617 nt, Artificial Sequence
  derived and/or modified sequence opt3 from VP1__Norovirus_and/or_Norovirus-like__JX445152
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaagcugggcagaauacuaaguucaccccagauggagucgugcaggacggcaacgguacacaccaaaaugagccccagcagugggucuugccgucuuacuccgggagaaccggccauaacgugcaccucgccccugcaauugccccaacuuuucccggagaacagcuguuauucuuuaggucaacgaugccuggcuguagcggguaccccaacaugaaucuggauugccuccuuccacaagaguggguucagcauuucuaucaggaggcugcgccugcacagagugacguggcccuguugcgguuuguaaaccccgauacaggacguguccuauucgaauguaaacugcacaagucugguuacgugaccguugcucacacuggccaacaugaccucgugauaccaccgaauggguauuuucgcuucgauuccugggucaaccaguucuacacccuggccccuaugggaaauggcacagguagaaggcgguga

SEQ ID NO: 21187 - RNA, 1617 nt, Artificial Sequence
  derived and/or modified sequence opt3 from VP1__Norovirus_and/or_Norovirus-like__JQ613553
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacagugcaggagaugaccaauagccgcuuuccaaucccccuggaaaaacuuuucacgggaccuuccucagcguucguugugcagccacaaaacgguagauguacuaccgauggcgucuugcuggggacaacucagcuaaguccggugaauauaugcaccuuuaggggagacguaacacauauucccggcagccggaacuacaccaugaaucucgccucucagaacuggaacuccuaugauccuacggaggagaucccagcaccccuggguacuccugacuucguugggaagauucagggagugcuuacacaaaccacucgcacaaauggcucaacccgaggccacaaggcuacggucuacaccgggagcgccgacuuuaguccaaagcugggaagagugcaguucgcuacagauacugacaaugauuuugaaaccaaccagaauacaaaauucacucccgucggugugauccaagacggcucuaccacaccgaggaacgagccucagcaguggguuuugccauccuacagcgggcggaauauccauaacgugcaccucgcccccgcaguagccccuaccuuucccggagaacagcuguuauucuuucguucgacuaugccaggcuguucugguuauccuaauauggaucuggacugccuccuuccccaagaguggguccaguacuucuaucaggaagcugcgccagcacaguccgauguggcccuguugcgcuuuguuaacccggacacggggagagugcuauucgaguguaagcugcacaaaucaggcuacgucacaguggcucauaccggacaacacgaucucguaauuccucccaacggcuauuuuagguucgacaguugggugaaucaguucuacacucuggccccaauggggaacggaaccggucggcgacgcuga

SEQ ID NO: 21188 - RNA, 1617 nt, Artificial Sequence
  derived and/or modified sequence opt3 from VP1__Norovirus_and/or_Norovirus-like__JQ613521
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucgggacuacaccaugaaccucgcuagccugaauuggaacaauuaugauccgacggaagagacucccgccccucuugggacaccagacuucguaggaaagauucagggcaugcugacccagacuacaaagggcgacgggucuacccgcggacacaaggcuacgguuuacaccgguuccgcccccuuuacaccuaaauugggcucagugcgauucagcacugauaccgaaaacgacuuugagacacaucagaauacuaaguucaccccagucggggugauccaagauggaaguacaacccacagaaacgaaccccagcaguggguccucccgucuuacuccggcagggacgugcacaauguucaucuggccccugcaguggcuccaacuuuucccggugagcaauuacuguucuuucggagcacgaugccuggguguucgggcuaucccaacauggaucucgacugccuucugccacaggaguggguacagcacuucuaccaggaagcggccccugcacaaucugaugucgcuuugcuacguuuugugaaucccgacacaggacgcguucuguucgaguguaaacuccauaaguccggcuaugugaccgucgcccacacugggcagcacgaucuggugaucccaccgaacggauacuuuagauucgacucauggguaaaucaguucuauacccuugcaccuauggguaacggcacagggaggcggcgauga

SEQ ID NO: 21189 - RNA, 1617 nt, Artificial Sequence
  derived and/or modified sequence opt3 from VP1__Norovirus_and/or_Norovirus-like__HQ005298
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccugucucggauguauaauggcuacgcugguggguucgaagugcaggucauucuagccggaaacgcguuuacugcaggcaaaaucauuuucgccgcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacgggaccuucaagugccuucguugugcagccacagaacgguagauguacuaccgauggcgucuugcuggggacaacucaacuaagcccggugaauauaugcaccuuuaggggagacguaacacauauuucuggcucccggaacuacaccaugaaucucgcgucacagaacuggaauagcuaugaucccacggaggaaaucccugccccacuggguacucccgacuucguugggaagauucagggagugcuuacacagaccacucgcacaaacggcaguacccgaggccacaaggcaacggucuacaccgggucugcugacuuuuccccuaagcugggaagagugcaauucgccacagauacugacaaugauuuugagaccaaccagaauacaaaauucacuccagucggugugauccaggacggcagcaccacacccaggaacgaaccgcaacaguggguuuugccuucguacucugggcggaauauccauaacgugcaccucgcuccagccguagcacccaccuuuccuggagagcagcuguuauucuuucguuccacuaugcccggcuguucagguuauccaaauauggaucuggacugccuccuuccucaggaauggguccaauacuucuaucaggaggccgcucccgcgcagagugauguggcacuguugcgcuuuguuaacccagacacggggagagugcuauucgaguguaagcugcacaaaagcggcuacgucacaguggcccauaccggacagcacgaucucguaauuccgccuaacggcuauuuuagguucgacuccugggugaaucaauucuacacucuggcucccauggggaacggaaccggucggcgacgcuga

SEQ ID NO: 21190 - RNA, 1617 nt, Artificial Sequence
  derived and/or modified sequence opt3 from VP1__Norovirus_and/or_Norovirus-like__HQ005296
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccugucucggauguauaauggcuacgcugguggguucgaagugcaggucauucuagccggaaacgcguuuacugcaggcaaaaucauuuucgccgcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacgggaccuucaagugccuucguugugcagccacagaacgguagauguacuaccgauggcgucuugcuggggacaacucaacuaagcccggugaauauaugcaccuuuaggggagacguaacacauauucccggcucucggaacuacaccaugaaucucgcgucccagaacuggaacucauaugauccuacggaggaaaucccagcaccccuggguacuccugacuucguugggaagauucagggagugcuuacacagaccacucgcacaaauggcagcacccgaggccacaaggccacggucuacaccgggagugcugacuuuucuccaaagcugggaagagugcaauucgccacagauacugacaaugauuuugagaccaaccagaauacaaaauucacucccgucggugugauccaggacggcuccaccacaccgaggaacgaaccucaacaguggguuuugccaagcuacucggggcggaauacccauaacgugcaccucgcucccgccguagcaccuacuuuucccggagagcagcuguuauucuuucguucuacgaugccaggcuguuccgguuauccuaauauggaucuggacugccuccuuccccaggaauggguccaauacuucuaucaggaggccgcuccagcgcagucagauguggcacuguugcgcuuuguuaacccggacacagggagagugcuauucgaguguaagcugcacaaaaguggcuacgucaccguggcccauacuggacagcacgaucucguaaucccucccaacggcuauuuuagguucgacagcugggugaaucaauucuacacccuggcuccaauggggaacggaacaggucggcgacgcuga

SEQ ID NO: 21191 - RNA, 1617 nt, Artificial Sequence
  derived and/or modified sequence opt3 from VP1__Norovirus_and/or_Norovirus-like__HM802555
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgccaccgacacagauaacgacuuugagacuggccagaauaccagauucacaccagugggggucauccaggauggaaguucugcucauaggaacgaaccccaacaguggguguugccggacuacuccggccggaccguucacaaugugcaccucgccccugcaguagccccaacuuuucccggugagcagcuguuauucuuucguagcacgaugccuggguguucgggcuaccccaacauggaucuggacugccuccuuccacaggaauggguccaacauuucuaucaggaggcugcgccugcacagucugauguggcccuguugcgcuuuguuaaucccgacacaggaagagugcuauucgaguguaagcugcacaaaaccggcuacgucacuguggcucauaccgggcagcacgaucucguaauuccaccgaacggauauuuuagguucgacuccugggugaaucaauucuacacacuggccccuauggguaacggcgcagggcggcgacgcuga

SEQ ID NO: 21192 - RNA, 1617 nt, Artificial Sequence
  derived and/or modified sequence opt3 from VP1__Norovirus_and/or_Norovirus-like__GQ246801
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucauaguugacgugcgccaacuggagccaguccuuaucccccugccugaugugcgaaauaacuuuuaucauuacaaucagucaaacgacccaacaauuaaguugaucgcaaugcucuauacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacacauucccggcagccggaauuacaccaugaaccucgccucucagaauuggaacuccuaugauccuacggaggaaaucccagcaccccuggguacuccugacuucguugggaagauucagggagugcuuacacagaccacucgcacaaauggcucaacccgaggccauaaggcuacggucuacaccgggagcgccgacuuuaguccaaagcugggaagagugcaauucgcuacagauacugacaacgauuuugagaccaaucagaacacaaaauucacucccgucggugugauccaggacggcucuaccacaccgaggaaugaaccucaacaguggguuuugccauccuacagcgggcggaacauccacaaugugcaccucgcccccgcaguagccccuaccuuucccggagagcagcuguuauucuuucguucgacuaugccaggcuguucugguuauccuaacauggaucuggacugccuccuuccccaggaauggguccaauacuucuaucaggaggcugcgccagcacaguccgauguggcccuguugcgcuuuguuaauccggacacggggagagugcuauucgaguguaagcugcauaaaucaggcuacgucacaguggcuuauaccggacagcacgaucucguaauuccucccaacggcuacuuuagguucgacaguugggugaaccaauucuauacucuggccccaauggggaauggaaccggucggcgacgcuga

SEQ ID NO: 21193 - RNA, 1617 nt, Artificial Sequence
  derived and/or modified sequence opt3 from VP1__Norovirus_and/or_Norovirus-like__AB504308
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcacgggcauaaggcuaccguuuccacaggaucaguggauuuuacuccuaaacuggguagcguccaauucgccaccgacacagauaacgacuuugagacuggccagaauacccgauucacaccagugggggucauccaggauggaaguucugcucacagaaacgaaccccaacaguggguguugccggacuacuccggcaggaccguucacaaugugcaucucgccccugcaguagccccaacuuuucccggugagcagcuguuauucuuucggagcacgaugccuggguguucgggcuaccccaacauggaucuggacugccuccuuccacaggaauggguccaacacuucuaucaggaggcugcgccugcacagucugauguggcccuguugcguuuuguuaaucccgacacaggacgcgugcuauucgaguguaagcugcauaaaaccggcuacgucacuguggcucacaccgggcagcacgaucucguaauuccaccgaacggauauuuuagauucgacuccugggugaaucaauucuacacacuggccccuauggguaacggcgcagggaggcggcgauga

SEQ ID NO: 21194 - RNA, 1617 nt, Artificial Sequence
  derived and/or modified sequence opt3 from VP1__Norovirus_and/or_Norovirus-like__DQ369797
augaagauggcccccaacgacgcuagcccuuccgauggcucuaccgcaaaucuggugccagaggucaacaaugaaguuauggcccucgagccggugguaggggcggcuaucgccgcacccguggccggacagcaaaacgucauugacccuuggauaagaaauaacuucgugcaggcuccagguggcgaauuuacaguuucacccaggaaugcaccuggggagauccuuuggagugccccacugggacccgauuugaacccuuacuuaagccaccuggcucggauguauaauggcuacgccgguggguucgaagugcaggucauucuagcgggaaacgcauuuacugccggcaaaaucauuuucgcugccgugccaccgaauuuucccacggagggccucuccccuucucagguaaccauguucccacauaucauaguugacgugcgccaacuggagcccguccuuaucccucugccagaugugcgaaacaauuuuuaucacuacaaccagucgaaugacucaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucacagugcccaucuuaaccgucgaggaaaugacuaauucucgcuuuccaauaccccuggagaaacuuuucacgggaccuagcuccgcguucgugguucagccacagaacgguagauguaccacagauggcguguugcuggggacuacccaacuaucaccggucaguauuugcacauuuaggggagacgugacccauauccccggcacgcggauuuaccgcaugaaucucgccagccagaacuggaauaacuaugauccuacugaggaaaucccagcaccccuggguacaccugacuucguagggaagauccagggaaugcuuacccagacuacaaagggcgacggcucuacccgagggcacaaggcuacgguuuccaccggaucaguggauuuuacaccaaaacuggguagcguccaauucgccacugacaccgauaaugacuuugagacaggccagaacacuagauucacccccgugggggucauucaggauggaaguucugcucauaggaaugaaccgcaacaguggguguugccugacuacuccggccggacaguucacaacgugcaccucgccccagcaguagcccccaccuuuccuggugagcagcuguuauucuuucguagcacuaugcccggguguucgggcuacccaaauauggaucuggacugccuccuuccucaggaauggguccaacauuucuaucaggaggcugcgcccucucaguccgauguggcacuguugcgcuuuguuaacccagacacgggaagagugcuauucgaguguaagcugcacaaagccggcuacgucacaguggcucauaccgggcagcacgaucucguaauaccgccuaauggauauuuuagguucgacucaugggugaaccaauucuacacucuggcccccauggguaauggcgcagggcggcgacgcuga

SEQ ID NO: 21195 - RNA, 1617 nt, Artificial Sequence
  derived and/or modified sequence opt3 from VP1__Norovirus_and/or_Norovirus-like__LC177661
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaguaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccacagauuuugacuucauuuuucucgugccucccaccgucgaaucucggacuaaaccauucagcgugccuguuuuaacaguggaggaaaugaccaacucccgcuuucccaucccacuggagaaacuuuucacgggacccucaagugccuucgucgugcagccucagaaugguagauguacuaccgauggcguauugcuggggacaacucaacuaagcccaguuaacauuugcaccuuuaggggagacgugacacauaucaccggcucucggaauuacacgaugaaccucgcaucccagaauuggaacaauuaugauccgacugaggaaauacccgcuccucuggguacaccagacuucgucgggaagauucagggaaugcuuacccagacuacacgcaccgacggcucaacgcgaggccacaaggccaccguguacacagggagcgcugauuuugcccccaagcugggaagaguccaauucgagacugacaccgaucaugacuuugaagcaaaccagaauacaaaauucacuccuguggguguuauccaggauggcaguaccacacacaggaacgagccacaacaguggguguugcccucuuacuccgggcggaauaccccgaacguacaccucgccccugcugucgcgccaacuuuucccggagaacagcuguuauucuuucguagcacgaugccuggcuguucggguuaucccaauauggaccuggauugccuccuuccacaggagugggugcaauacuucuaucaggaggcagccccugcucagucugacguugcccuguugcgcuuugugaaccccgauacagggagaguccuauucgaauguaagcugcauaaauccggcuacgugaccguagcacacacuggacagcaugaccucgugauuccaccgaauggcuauuuuagguucgauucauggguuaaccaauucuacacccuggccccuauggggaacggaacaggucggcgacgcuga

SEQ ID NO: 21196 - RNA, 1617 nt, Artificial Sequence
  derived and/or modified sequence opt3 from VP1__Norovirus_and/or_Norovirus-like__LC175468
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacacacaauguucaucucgccccggcuguggcgccuaccuuuccaggagaacagcuguuauucuuucguagcacuaugcccggcuguucggguuauccuaacauggaccuggauugccuccuuccccaggaguggguacaauacuucuaucaggaggcagccccagcucagucugacgucgcccuguugcgcuuugugaauccugauacggggagaguucuauucgaauguaagcugcacaaauccggcuacgugacagucgcacauaccggacagcacgaccucgugauucccccaaacggcuauuuuagguucgauucauggguaaaccaauucuacacucuggccccgauggggaauggaaccggucggcgacgcuga

SEQ ID NO: 21197 - RNA, 1617 nt, Artificial Sequence
  derived and/or modified sequence opt3 from VP1__Norovirus_and/or_Norovirus-like__KX354137
augaagauggccagcuccgacgcuaaccccucugauggcucagcagccaaucuggugccugaggucaguaacgaaguuauggcgcucgagccagugguaggggcugccaucgcagccccgguggcuggacagcaaaauauuauagaccccuggaucagaaacaauuucguccaggcaccugguggcgaauuuaccgugagcccaaggaacgcccccggggagauucuuugguccgcuccucugggaccagauuugaaucccuacuuaucucaccuggcccggauguauaacggcuacgcggguggguucgaaguucaggugauccuagcaggaaaugccuuuacagcuggcaaaauuaucuucgccgcagucccuccaaacuuuccgacugagggccucucgcccucacaggugacgauguucccucauauaaucguagacguucgccaacuggagccagugcuuauuccccugccugauguccgaaauaacuuuuaucacuacaaucagagcaacgacccaaccaucaaguugauugcuaugcucuauacaccccugcgugccaauaacgcgggggaugacguguucacugugaguugcagaguccugaccaggccguccccugauuuugacuucaucuuucucguucccccaacaguggaaucucggaccaaaccuuucagcguacccauauuaacuguggaggaaaugacaaacucccgcuuuccaauuccccuggagaaguuauucaccggaccuucaagugccuucgucgugcagccacagaaugguagauguacgacugauggcguuuugcuggggaccacacaacuaagcccggugaacaucugcacuuuuaggggagacgucacccauauuacaggcucucacaauuacaccaugaaccucgcaucccagaauuggaacaauuaugaucccacggaggaaaucccugcuccacuggguacucccgacuucguggggaaaauccagggaguacuuacacagaccacucggucagacggcagcacacgcggccauaaggccaccguuuacacggggagugcugauuuugccccuaagcugggacgagugcaauucgagaccgacacagauagagacuuugaaacuaaccagaauaccaaauucacaccagucggugugauucaggauggcacuaccgcacacaggaacgagccccaacagugggucuugccgucuuacuccgggcggaauauacacaacgugcaucucgccccugcuguugcgccaacauuucccggagaacagcugcuuagcuuccguucgaccaugccuggcuguucugguuaucccaauauggaccuggauugccuccuuccacaggagugggugcaauacuuuuaucaggaggcagccccugcucaguccgacguagcccuguugcgcuucgucaaccccgauacugggagagugcuauuugaauguaagcugcacaaaucaggcuacguuacgguggcacauacaggacagcacgaccucgucaucccaccgaauggcuauuucagguuugauaguugggugaaccaauucuacacccuggccccuauggggaacggaacuggucggcgacgcuga

SEQ ID NO: 21198 - RNA, 1617 nt, Artificial Sequence
  derived and/or modified sequence opt3 from VP1__Norovirus_and/or_Norovirus-like__KX354036
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguucaccugacuucguugggaagauucagggagugcuuacucagacaacccgcacuaauggcagcacacgaggccacaaggcuaccgucuacacggggagugccgacuuuucuccaaagcugggaagagugcaauucgcuaccgauacagacaaugauuuugagacuaaccagaauaccaaauucacacccgucggugugauccaggacggcuccacuaccccgaggaacgaaccucaacaguggguuuugccaagcuacucggggcggaauauccauaacgugcaccucgcccccgcaguagccccuacauuucccggagagcagcuguuauucuuucguucuaccaugccaggcuguuccgguuauccuaauauggaucuggacugccuccuuccccaggaauggguccaauacuucuaucaggaggcugcgccagcacagucagauguggcccuguugcgcuuuguuaacccggacacugggagagugcuauucgaguguaagcugcacaaaaguggcuacgucacgguggcucauacaggacagcacgaucucguaauuccucccaacggcuauuuuagguucgacagcugggugaaucaauucuacacccuggccccaauggggaacggaacuggucggcgacgcuga

SEQ ID NO: 21199 - RNA, 1617 nt, Artificial Sequence
  derived and/or modified sequence opt3 from VP1__Norovirus_and/or_Norovirus-like__KX354011
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacaguacaauuaaguugaucgcaaugcucuauacuccacugcgugcuaauaacgccggggaugacguguucaccgucuccugcagaguucugacaaggcccucuccggauuuugacuucauuuuucucgugccucccaccguagaaagccggacuaaaccauucuccgugccuaucuuaacagucgaggaaaugaccaacucacgcuuucccauaccacuggagaaacuuuucacgggacccaguagcgcguucgugguucagccucagaaugguagauguacuaccgauggcguguugcuggggacaacucaacuaucuccagucaacauuugcaccuuuaggggagacgugacacauaucccgggcucccacaauuacaccaugaaccucgccucacagaauuggaacagcuaugaucccacggaggaaauuccugcaccacuggguacucccgacuucguagggaagauccagggaguucuuacacagaccacaaguacuaauggcucuacccggggccauaaggcuacgguguacaccggguccgccgacuuuagcccuaagcugggacgcguccaauucgcuacagauacuaacaaugacuuugagaccaaccagaauacaaaauucacuccagugggugucauccaggauggcucgaccacaccccgaaacgaaccgcaacaguggguguugccuucuuacuccgggagaaauauucacaacguucaccucgccccagcaguggcccccaccuuuccuggagagcagcuguuauucuuuaggucaacuaugcccggcuguagugguuauccaaauauggaccuggauugccuccuuccucaggaauggguacaauacuucuaucaggaggcugcgcccgcacagagcgacgucgcccuguugcgguuugugaacccagauacggggcguguucuauucgaguguaagcugcauaaauccggcuacgugacagucgcucacaccggacagcaugaccucgugauaccgccuaacggcuauuuucgcuucgauucuuggguaaaucaauucuacacucuggcccccauggggaacggaaccgguagaaggcgguga

SEQ ID NO: 21200 - RNA, 1617 nt, Artificial Sequence
  derived and/or modified sequence opt3 from VP1__Norovirus_and/or_Norovirus-like__LC153122
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucguuucccagaacuggaauaacuaugauccgacggaggaaauccccgcaccucuggguacuccagacuucguggggaagauucagggaaugcuuacacagaccacucgcacagacggcucaacccgaggccacaaggcuacggucuacaccgggagcgccgauuuugcucccaagcugggaagagugcaauucgagacagacacugaucaugacuuugaagccaaucagaacaccaaauucacaccugucggugugauccaggauggcaguacuacccacaggaaugagccacaacaguggguuuugcccucuuacuccgggcggaacacacacaaugugcaucucgcaccggccguagcuccuaccuuuccaggagaacagcuguuauucuuucguagcacuaugcccggcuguucggguuauccuaacauggaccuggauugccuccuuccccaggaguggguccaauacuucuaucaggaggcggcaccagcccagucugacguggcucuguugcgcuuuguuaauccugauacggggagagugcuauucgaauguaagcugcacaaauccggcuacgucacaguggcccauaccggacagcacgaccucguaauucccccaaacggcuauuuuagguucgauucaugggugaaccaauucuacacucuggcaccgauggggaauggaaccggucggcgacgcuga

SEQ ID NO: 21201 - RNA, 1617 nt, Artificial Sequence
  derived and/or modified sequence opt3 from VP1__Norovirus_and/or_Norovirus-like__KR131777
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacugguccucauaugauccuacggaggaaaucccagcaccccuggguacuccugacuucguugggaagauucagggagugcuuacacagaccacucgcacaaauggcagcacccgaggccacaaggcuacggucuacaccgggagugccgacuuuucuccaaagcugggaagagugcaauucgcuacagauacugacaacgauuuugagaccaaucagaacacaaaauucacucccgucggugugauccaggacggcuccaccacaccgaggaaugaaccucaacaguggguuuugccaagcuacucggggcggaacauccauaaugugcaccucgcccccgcaguagccccuaccuuucccggagagcagcuguuauucuuucguucuacuaugccaggcuguuccgguuauccuaacauggaucuggacugccuccuuccccaggaauggguccaauacuucuaucaggaggcugcgccagcacagucagauguggcccuguugcgcuuuguuaauccggacacggggagagugcuauucgaguguaagcugcacaaaaguggcuacgucacaguggcucauaccggacagcacgaucucguaauuccucccaacggcuauuuuagguucgacagcugggugaaccaauucuacacucuggccccaauggggaauggaaccggucggcgacgcuga

SEQ ID NO: 21202 - RNA, 1617 nt, Artificial Sequence
  derived and/or modified sequence opt3 from VP1__Norovirus_and/or_Norovirus-like__AB933764
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccaguugaaugacccaacaauuaagcucaucgcaaugcuguauacuccccugcgugcuaacaacgccggggaugacguguucaccgucucaugcagaguucucacaaggccgagcccugauuuugacuucaucuuuuuagugcccccaaccguagaaagucggacuaaaccuuucuccgugcccguccugacaguggaggaaaugaccaauucucgcuuuccaauuccccuugagaaguuguucacgggaccuagcuccgcguucguugugcagccacagaacgguagauguacuaccgauggcguccugcuagggacaacucaacucucaccggugaauauaugcaccuuuaggggagacguaacacauauucccggcagucggaacuacaccaugaaucuggccagccagaacuggaacucuuaugauccuacggaggaaaucccagcaccccuugguacuccugacuucguugggaaaauucagggagugcugacacagaccacucgcacaaauggcuccacccgaggccacaaggcuacggucuacaccgggucagccgacuuuagcccaaaguugggaagagugcaauucgcuacagauacugacaaugauuuugagaccaaccagaauacaaaauucacucccgucggugugauccaggacggcaguaccacaccgaggaacgaaccucaacaguggguucucccaucuuacuccgggcggaauauccauaacgugcaccuggcccccgcaguagccccuaccuuucccggagagcaguuacuguucuuucguagcacuaugccaggcuguucggguuauccuaauauggaucucgacugccuucugccccaggaauggguccaauacuucuaucaggaggcugcgccagcacagucugauguggccuugcuacgcuuuguuaacccggacacggggagagugcuguucgaguguaagcuccacaaauccggcuacgucacaguggcucauaccggacagcacgaucugguaauuccucccaacggcuauuuuagguucgacucaugggugaaucaauucuacacucuugccccaauggggaacggaaccggucggcgacgcuga

SEQ ID NO: 21203 - RNA, 1617 nt, Artificial Sequence
  derived and/or modified sequence opt3 from VP1__Norovirus_and/or_Norovirus-like__LC016600
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgagcacuuaccggaugaaccucgccucucagaauuggaacaauuaugaucccacagaggaaauuccugcaccacuggguacccccgacuucguagggaagauccagggaaugcuuacucagacaaccaagggcgacggcuccacgcgcgggcacaaggcuaccguuucaacaggaagcguggauuuuacuccuaaacuggguaguguccaauucgccaccgacacagauaacgacuuugagacuggccagaauacccgauucacaccagugggggucauccaggauggaucuggcgcucauagaaacgaaccccaacaguggguguugccgaauuacuccgguaggaccguucacaacgugcaccucgccccugcaguagccccaacuuuucccggggagcagcuguuauucuuucggagcacgaugccuggcuguucgggauaccccaauauggaccuggauugccuccuuccacaggaauggguccaacauuucuaucaggaggcugcgccugcacagucugacguggcccuguugcguuuuguuaaccccgauacaggccgcgugcuauucgaguguaagcugcacaaaaccggguacgucacuguggcucauaccggacagcacgaccucguaauuccaccgaaugguuauuuuagauucgauuccugggugaaccaauucuacacacuggccccuaugggcaacggggcaggaaggcggcgauga

SEQ ID NO: 21204 - RNA, 1617 nt, Artificial Sequence
  derived and/or modified sequence opt3 from VP1__Norovirus_and/or_Norovirus-like__KJ433970
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacuacccacaggaacgagccccaacaguggguauugccgucuuacuccgggcggaauacaccuaacguccaccucgccccagcuguggcgcccaccuuuccuggagaacagcuguuauucuuucguagcacuaugcccggcuguucggguuauccaaauauggaccuggauugccuccuuccucaggaguggguucaauacuucuaucaggaggcagcccccgcucagucugacguggcccuguugcgcuuugucaacccagauacggggagagugcuauucgaauguaagcugcauaaauccagguacguaacaguggcacacaccggccagcaugaccucguuauuccgccuaauggauauuuucgguucgauucaugggucaaccaauucuacacucuggcccccaugggcaacgggaccggacgacgcagauga

SEQ ID NO: 21205 - RNA, 1617 nt, Artificial Sequence
  derived and/or modified sequence opt3 from VP1__Norovirus_and/or_Norovirus-like__KP176395
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcguggauuuugcuccuaagcugggaagaguucaauucgagacagacacugaucaugacuuugaagccaaccagaauaccaaauucacaccaguggguguaauccaggauggcaguacuacccacaggaacgagccccaacagugggucuugccgucuuacuccgggcggaauacaccuaacgugcaccucgcaccagccguugcucccaccuuuccuggagaacagcuguuauucuuucguagcacuaugcccggcuguucggguuauccaaauauggaccuggauugccuccuuccucaggagugggugcaauacuucuaucaggaggcggcacccgcccagucugacgucgcucuguugcgcuuugugaacccagauacggggagaguacuauucgaauguaagcugcauaaauccggcuacgugacaguugcccacaccggacagcaugaccucgucauuccgccuaauggcuauuuuagguucgauucaugggugaaccaauucuacacucuggcacccauggggaacggaaccggucggcgacgcuga

SEQ ID NO: 21206 - RNA, 1617 nt, Artificial Sequence
  derived and/or modified sequence opt3 from VP1__Norovirus_and/or_Norovirus-like__KM982947
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauugcuguggacguccgccaacuggagccagugcuuaucccccugccugaugugcgaaacaauuuuuaucacuacaaccagucaaaugacccaaccauaaaguugaucgccaugcucuauacaccccugcgugcgaacaacgccggggaugacgucuucacuguuagcugcagagugcugaccaggccgaguccugauuuugacuucauuuuucucguacccccaacaguggaaucccggaccaaaccuuucucuguccccguguuaacuguugaggaaaugacaaauagccgcuuuccaaucccccuggagaaacuuuucaccggaccuuccucagcauucgugguccagccacagaacgguagauguacgacugauggcguguugcuggggaccacacaacuaaguccgguaaauauuugcacuuuuaggggagacguuacccauaucacaggcagccggaacuacaccaugaaucucgcuucucagaacugguccaauuaugaucccacggaggaaauaccugccccacuggguacucccgacuucguggggaagauucagggaguccuuacacagaccacucgcacagacggcucaacccgaggccacaaggcuacgguguacaccgggagcgccgauuuugcaccuaagcugggaagaguccaauucgagacagacacugaucaugacuuugaagccaaccagaauaccaaauucacaccaguggguguuauccaggauggcgggacuacccacaggaacgagccccaacaguggguguugccgaguuacucuggacggaauacaccuaacguacaccucgcuccagcggucgcacccaccuuuccuggcgaacagcuguuauucuuucguuccacuaugcccgguuguagcggguauccaaauauggaccuggauugccuccuuccucaggagugggugcaauacuucuaucaggaggccgcucccgcccagucggacguugcacuguugcgcuuugugaacccagauacgggcagaguccuauucgaauguaagcugcauaaaucuggauacgugacaguagcccacaccggccagcaugaccucgugauuccgccuaauggguauuuuagguucgauuccuggguuaaccaauucuacacucuggcucccaugggaaacgguaccggccggcgacgcuga

SEQ ID NO: 21207 - RNA, 1617 nt, Artificial Sequence
  derived and/or modified sequence opt3 from VP1__Norovirus_and/or_Norovirus-like__KJ685414
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaagcgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauucccggcucucggaauuacaccaugaaccucgccucccagaauuggaacucauaugauccuacggaggaaaucccagcaccccuggguacuccugacuucguugggaagauucagggagugcuuacacagaccacucgcacaaauggcagcacccgaggccacaaggcuacggucuacaccgggagugccgacuuuucuccaaagcugggaagagugcaauucgcuacagauacugacaacgauuuugagaccaaucagaacacaaaauucacucccgucggugugauccaggacggcuccaccacaccgaggaaugaaccucaacaguggguuuugccaagcuacucggggcggaacauccauaaugugcaccucgcccccgcaguagccccuaccuuucccggagagcagcuguuauucuuucguucuacuaugccaggcuguuccgguuauccuaacauggaucuggacugccuccuuccccaggaauggguccaauacuucuaucaggaggcugcgccagcacagucagauguggcccuguugcgcuuuguuaauccggacacggggagagugcuauucgaguguaagcugcacaaaaguggcuacgucacaguggcucauaccggacagcacgaucucguaauuccucccaacggcuauuuuagguucgacagcugggugaaccaauucuacacucuggccccaauggggaauggaaccggucggcgacgcuga

SEQ ID NO: 21208 - RNA, 1617 nt, Artificial Sequence
  derived and/or modified sequence opt3 from VP1__Norovirus_and/or_Norovirus-like__KF060093
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucaccaaucagaacacaaaauucacuccaguggguguuauccaggauggcaauaccacacccaggaacgagccgcaacaguggguguugccuuccuacagcgggcggaauacccauaacguacaccucgccccagcagucgcccccacuuuuccuggagaacagcuguuauucuuucguucgacgaugcccggcuguucugguuauccaaauauggaccuggauugccuccuuccucaggagugggugcaauacuucuaucaggaagcugcgcccgcacaguccgacguugcccuguugcgcuuugugaacccagauacagggagaguccuauucgaguguaagcugcacaaaccgggcuacgugaccguagcucauacuggacagcacgaccucgugaucccucccaacggcuauuuuagguucgauucauggguuaaucaauucuacacccuggccccaauggggaacggaacaggucggcgacgcuga

SEQ ID NO: 21209 - RNA, 1617 nt, Artificial Sequence
  derived and/or modified sequence opt3 from VP1__Norovirus_and/or_Norovirus-like__KC456070
augaagauggccagcuccgacgcuaaccccucugauggcucagcagccaaucuggugccuaaagucaacaaugagguuauggcgcucgaaccagugguaggggcugccaucgcagccccgguggcuggacagcaaaacgucauugaccccuggauaaagaauaacuucgugcaggcaccugguggcgaguuuaccguuagucccaaaaaugccccaggggaaauccuuuggagcgcuccucugggaccagauuugaaccccuacuuaucccaccuggccaagauguauaauggcuacgcggguggguucgaggugcaggucauucuagcaggaaacgccuuuacagcuggcaaagugaucuucgccgcaguaccuccaaauuuuccgacugaaggccucucucccucgcagguuacgauguucccucauauuguggucgacgugagacaacuggagccagugcuuaucccccugccugaugucaggaacaauuuuuaucacuacaaccagucaaaugacccaaccauaaaguugaucgcuaugcucuauacaccccugcgggccaacaacgcgggggaugacguuuucacugugagcugccgcguacugacccgaccgaguccugauuuugacuucauuuuucucgugcccccaacagucgagucccguaccaagccuuucucugugcccguuuuaacuguggaagagaugacaaauagcagauuuccaaucccccuggaaaaacuuuucaccggaccuuccucagccuucgucgugcagccacagaacgguagguguacgacugauggcguauugcuggggaccacacaacuaaguccgguuaauauuugcacuuuucggggagacgugacccauacaaucggcagccgcaacuacaccaugaaucucgcaucucagaacuggaauaacuaugaucccacggaggagauaccugcuccacuggguacucccgacuucgucgggaagauucagggagugcuuacacagaccacuagaacagacggcuccaccaggggccacaaagccacggucuacaccgggucagcugauuuugccccuaagcugggacgggugcaauucgaaacagacacugaucaugacuuugaggcaaaucagaacaccaaauucacaccaguuggugugauccaggauggcagcacuacccaccgcaaugaaccccaacaguggguauugccgaguuacucugggcgaaacacacacaauguccaucucgccccugcuguggcgccaaccuuucccggagagcagcuguuauucuuuagauccacuaugccuggcuguagcgguuaucccaacauggaccuggauugccuccuuccacaggaauggguucaauacuucuaucaggaggcagccccugcucagucggacguggcccuguugagguuugucaaucccgauacggggcgggugcuauucgaguguaagcugcacaagucuggcuacguaacaguggcacauaccggacagcacgaccucguuauuccaccgaacggcuauuuucguuucgauuccugggucaaccaauucuacacucuggccccuauggggaauggaaccggucgcagaagguga

SEQ ID NO: 21210 - RNA, 1617 nt, Artificial Sequence
  derived and/or modified sequence opt3 from VP1__Norovirus_and/or_Norovirus-like__KC409299
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccaacgcguucguugugcagccacagaaugguagauguacuaccgauggcgucuugcuggggacaacucaacuaucaccggugaacauaugcaccuuuaggggagacguaacacauauucccggcagucggaauuacaccaugaaccucgccagccagaauuggaacucuuaugauccuacggaggaaaucccagcaccccuggguacuccugacuucguugggaagauucagggagugcuuacacagaccacucgcacaaauggcuccacccgaggccacaaggcuacggucuacaccgggucagccgacuuuagcccaaagcugggaagagugcaauucgcuacagauacugacaacgauuuugagaccaaucagaacacaaaauucacucccgucggugugauccaggacggcaguaccacaccgaggaaugaaccucaacaguggguuuugccaucuuacuccgggcgggaugugcauaacguacaccucgcccccgcagucgccccuaccuuucccggagagcagcuguuauucuuucguagcacuaugccaggcuguucggguuauccuaauauggaccuggauugccuccuuccccaggaaugggugcaauacuucuaucaggaggcugcgccagcacagucugacguugcccuguugcgcuuugugaacccggauacggggagaguccuauucgaguguaagcugcacaaauccggcuacgugacaguagcucauaccggacagcacgaccucgugaucccucccaacggcuauuuuagguucgauucauggguuaaucaauucuacacucuggccccaauggggaacggaaccggucggcgacgcuga

SEQ ID NO: 21211 - RNA, 1617 nt, Artificial Sequence
  derived and/or modified sequence opt3 from VP1__Norovirus_and/or_Norovirus-like__JX984947
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguuccgacuuugauuucauuuuucucgugccgccuacaguagagucucggaccaaacccuucacugugccaaucuuaacagucgaagagaugaccaacagccgcuuuccuauaccccuggagaaacuuuucacgggaccauccucagccuucgugguucagccccagaaugguagauguacuaccgacggcguguugcuggggacaacucaacuaaguccugucaauaccugcacauuuaggggagaugugacccauauugcaggcagccggaacuacacgaugaaccucgcuucucugaauuggaacaauuaugacccaacugaagagaucccggcaccccuugguacaccugauuucguagggaagauucagggaguucugacccagacuacaaagggcgacggcuccacccgcgggcacaaggcuacgaucuacaccggaucagccccauuuacacccaaauuggguagcgugcaguucaacacugacaccgaaaaugauuuugagacacaucaaaacacuaaguucaccccugucggcgugauccaggacgggggaacaacccaccgaaaugaaccacagcaauggguccuccccaguuacucuggcagaaacauuccgaaugugcaccuggccccugccguugcuccaacuuuucccggugagcaguuacuguucuuuagguccacgaugccuggguguagcggcuaucccaacauggaucucgacugccuucugccacaggagugggugcagcauuucuaccaagaagcggccccugcacagucggauguagcuuugcuacgguuugucaaccccgacacaggacgugugcuguucgaguguaaacuccacaagucuggcuauguuaccguggcccauacugggcagcacgaucuggucauaccaccgaauggauacuuucgcuucgacuccugggugaaccaguucuauacccuugcaccuauggguaauggcacagggagaaggcgguga

SEQ ID NO: 21212 - RNA, 1617 nt, Artificial Sequence
  derived and/or modified sequence opt3 from VP1__Norovirus_and/or_Norovirus-like__KC175385
augaagauggccagcuccgacgcuaaccccucuaauggcucaaccgcaaaccuggugccugaggucaauaacgaaguuauggcccucgagccagugguaggggcggcuaucgccgcaccgguggccggacagcaaaaugucauugaucccuggauaagaaacaauuucgugcaggcuccugguggcgaauuuacaguuaguccaaggaacgcacccggggagauccuuuggagcgccccucugggaccagacuugaaucccuacuuaucccaccuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucauaucauaguugaugugcgccaacuggagccaguccuuaucccccugccugacgugcgaaauaacuuuuaucacuacaaucagucaaacgauccaacaauuaaguugaucgcaaugcucuauacuccccugcgugcuaacaaugccggggacgauguguucaccgucagcugcagaguucugacaaggccgaguccugacuuugauuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgacggcgucuugcuggggacaacucaacuaaguccggugaacauaugcaccuuuaggggagauguaacacauauucccagcucucacaauuacaccaugaaccucgccucccagaauuggaacucauaugacccuacggaggaaaucccagcaccccugggcacuccugauuucguugguaagauucagggggugcuuacacagaccacucggacagacggaagcacccgcggccauaaggcuacggucuacaccggcagugccgacuuuucuccaaagcuggggcgagugcaauucgcuacagauacugacaaugauuuucagaccaaccagaauacaaaauucacucccgucggagugauccaagacgguuccaccacaccgagaaacgagccucagcaguggguuuugccaagcuacucgggcaggaauauccacaacgugcaccucgcccccgcaguagccccuaccuuucccggggaacagcuguuauucuuucggucuacuaugccaggauguuccggcuauccuaauauggaucuggacugccuccuuccccaagaguggguccaguacuucuaucaggaagcugcgccagcacagucagauguggcccuguugcguuuuguuaacccggacacgggucgcgugcuauucgaguguaagcugcauaaaaguggguacgucacaguggcucacaccggccaacaugaucucguaauuccucccaacggauauuuuagauucgacagcugggugaaucaguucuacacucuggccccaaugggcaacgggaccggaaggcggcgauga

SEQ ID NO: 21213 - RNA, 1617 nt, Artificial Sequence
  derived and/or modified sequence opt3 from VP1__Norovirus_and/or_Norovirus-like__JQ613563
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaugaucguugacgugcgccaacuggagccaguccuuauaccccugccugaugugcgaaacaauuuuuaucacuacaaccagucaaaugacccaacaaucaaguugauugcaaugcucuauacuccccugcgugcuaacaacgccggggaugacguguucaccgucagcugcagaguucugacaaggccgaguccugauuuugacuucaucuuucucgugcccccaaccguagaaucccggacuaaaccuuucucugugcccgucuuaacaguggaggaaaugaccaauagccgcuuuccaauuccccuggagaaacuuuucacgggaccuuccucagcguucguugugcagccacagaacgguagauguacuaccgauggcgucuugcuggggacaacucaacuaaguccggugaauaucugcaccuuuaggggagacguaacacauacccccggcagccacaacuacacgaugaaucucgccucucagaacuggaacuccuaugauccuacugaggaaauaccagcaccccuggguacaccugacuucguugggaagauucagggagugcuuacccagacuacacggaccaauggcucaacgcgcggccauaaggcuaccgucuacacagggagcgccgacuuuaguccaaagcugggacgagugcaauucgcuacugauaccgacaaugauuuugagacaaaccagaauacuaaauucacccccgucggugugauccaggacggcucuacaaccccgagaaacgaaccucaacaguggguuuugccauccuacagcgggaggaauauucacaacgugcaccucgcccccgcaguagccccuacuuuucccggagagcagcuguuauucuuucggucgacgaugccaggcuguucugguuauccuaauauggaucuggacugccuccuuccccaggaauggguccaauacuucuaucaggaggcugcgccagcacaguccgauguggcccuguugcguuuuguuaacccggacacagggcgcgugcuauucgaguguaagcugcauaaaucaggcuacgucaccguggcucacacuggacagcaugaucucguaaucccucccaacggcuauuuuagauucgacaguugggugaaucaauucuacacccuggccccaauggggaacggaacagguaggcggcgauga

SEQ ID NO: 21214 - RNA, 1617 nt, Artificial Sequence
  derived and/or modified sequence opt3 from VP1__Norovirus_and/or_Norovirus-like__JQ613558
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaucaggcuacgucacaguggcucauauuggacaguaugaucucguaauaccucccaacggcuacuuuagguucgacaguugggugaaucaauucuauacccuggccccaauggggaacggaacuggucggcgacgcuga

SEQ ID NO: 21215 - RNA, 1617 nt, Artificial Sequence
  derived and/or modified sequence opt3 from VP1__Norovirus_and/or_Norovirus-like__GQ856451
augaagauggccagcaacgacgcuaaucccuccgauggcucuguggcaaaccuggucccugagguuaauaacgaagugauggcccucgagccaguagugggggcggcuaucgccgcaccggucgccggacagcaaaaugugauugaccccuggauaagaaacaauuucguucaggcuccugguggcgaauuuaccgugucaccaaggaacgcacccggggagauccuuuggagugccccucugggaccagauuugaaucccuacuuaagccaccuggcucggauguauaacggcuacgccgguggguucgaaguccaggugauucuagcgggaaaugcauuuacagccggcaaaaucauuuucgcugccguaccuccaaacuuuccgacugagggccucucccccucucagguuacgauguucccucauaugaucguggacguccgccaacuggagccagugcuuauaccccugccugaugugcgaaauaacuuuuaucacuacaaucagucgaacgacucaaccaucaaguugauugcaaugcucuauacaccacugcgugcugauaacgccggggaagacgucuucacuguuagcugcagagugcugaccaggcccaguccggauuuugacuucaucuuucucguaccucccacaguggaguccaaaaccaagccauucacugucccuauuuuaacaguggaagagaugaccaauucucgguuucccaucccacuggagaaacuuuucacgggacccagcuccacuuucguugugcagccucagaacggucgcuguaccacagauggcgucuugcuggggacuacccaacuaucaccagugaauauaugcacauuuagaggagacguaacccauauugcgggcaguaggaacuacacgaugaaucucgccagccugaacuggaauaacuaugauccgacugaagagauccccgcaccucuugguacaccagacuucguugggaagauucagggagugcugacccagacuacaaagggcgacggcucuacccgggggcacaaagcuacggucuacaccggauccgcccccuuuacaccuaaguuggguucagugcaguucagcacugauaccgaaaaugacuuugagacacaucaaaacacuaaauucaccccagucggcgugauccaggaugggaguacaacccaccgcaaugaaccccagcaauggguucucccgucuuacuccggacgaaacgugcacaauguacaucuggcuccugccgucgcaccaacuuuucccggcgagcaguuacuguucuuuagaagcacgaugccugguuguucgggguaucccaacauggaccucgauugccuucugccacaggagugggugcagcacuucuaccaagaagccgcuccugcgcagucugacguugcauugcuaagguuugugaaucccgauacaggccggguccuguucgaguguaagcuccauaaauccggauaugugaccguagcccacacuggccagcacgaccuggugaucccaccgaacggguacucacguuuugauaguuggguuaaccaguucuauacccuugcuccuaugggaaaugguacaggccgcagaagguga

SEQ ID NO: 21216 - RNA, 1617 nt, Artificial Sequence
  derived and/or modified sequence opt3 from VP1__Norovirus_and/or_Norovirus-like__DQ419908
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggacagcguccaauucgccaccgauacagacaacgauuuugagacuggucagaauaccagauucacaccagugggcgucauccaggacgggaguucugcucauaggaacgaaccccaacaguggguguugccggauuacuccggacggaccguucacaaugugcaccucgccccugcaguagccccaacuuuucccggcgagcagcuguuauucuuucguagcacgaugccugguuguucgggguaccccaacauggaccuggauugccuccuuccacaggaauggguccaacauuucuaucaggaggcugcgccuucucaguccgacguggcacuguugcgcuuuguuaaucccgauacaggcagagugcuauucgaguguaagcugcacaaagccggauacgucaccguggcucauacuggccagcacgaccucguaauuccaccgaacggguauuuuagguucgacucaugggugaaucaauucuacacccuggccccuaugggaaacggugcaggccggcgacgcuga

SEQ ID NO: 21217 - RNA, 1617 nt, Artificial Sequence
  derived and/or modified sequence opt3 from VP1__Norovirus_and/or_Norovirus-like__KX514354
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccgugcaggagaugacuaacucccgcuuucccgccacacuggauaaacuuuucaccggaccaucaaguacguugguugugcagccccaaaaugguagauguaugaucgacggcguccugcuagggacuacccagcucagcccugugaacauaugcacauucaggggagauguaacucauucucgggacuccaccauuuacacaaugaaucuggcaucaccaaacuggaauaacuaugacccgaccgaagagauccccgcuccucuuggcacgccagauuuuguugguaagauucagggggugcugacucagacaaccaagggagagggcagcacucgcggccaccgagccacagucuacguggggagugcuaauuacacccccaaguugggaaaaguccaauucgaaacgaacaccacaaaugaccucuaugcccaucagaacacuagauuuaccccuguggguguugugcagggcggggagucugcacacagguccgaaccacaacaguggguacugcccagcuacucgggacgggauacaccgaauguccacuuagccccugcuguggcgccaacuuuccccggcgagcagcugcucuuuuuccguucuaccaucccugguugugggggccaucccaacauggaccuugauugccuguugccacaggaauggguucaacacuuuuaucaggaggcagccccugcucaguccgacguggcccuacugcgcuucgucaaucccgauacaucaagagugcucuuugaguguaagcugcauaaaaguggauacguaaccguggcacacacuggccagcacgaccuuguuaucccaccgaacggguauuucagguuugauagcugggucaaccaauucuacacgcuggccccuaugggaaaugguacaggccggaagcgauga

SEQ ID NO: 21218 - RNA, 1617 nt, Artificial Sequence
  derived and/or modified sequence opt3 from VP1__Norovirus_and/or_Norovirus-like__KX354062
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgaacucucacaauuacaccaugaaccucgccucccagaauuggaacucauaugaucccacggaggaaauuccugcaccacugggcacucccgacuucguagguaagauccaggggguucuuacacagaccacuagcacaaauggaaguacccggggccauaaggcuacgguguacaccggcucugccgacuuuuccccuaagcuggggcgcguccaauucgcuacagauacuaacaaugacuuugagaccaaccagaauacaaaauucacuccagugggagucauccaggaugguagcaccacaccccgaaacgaaccgcaacaguggguguugccuucguacucuggcagaaauauucacaacguucaccucgccccagcaguggcccccaccuuuccuggggagcagcuguuauucuuuagguccacuaugcccggauguucaggcuauccaaacauggaccuggauugccuccuuccucaggaauggguacaauacuucuaucaggaggcugcgcccgcacagagugacgucgcccuguugcgguuugugaauccagauacgggucguguucuauucgaguguaagcugcauaaaagcggguacgugacagucgcucacaccggccagcaugaccucgugauaccgccuaacggauauuuucgcuucgauuccuggguaaaucaauucuacacucuggcccccaugggcaacgggaccggaagaaggcgguga

SEQ ID NO: 21219 - RNA, 1617 nt, Artificial Sequence
  derived and/or modified sequence opt3 from VP1__Norovirus_and/or_Norovirus-like__AB972532
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaucccacuggagaaacuuuucaccggacccucaagugccuucgucgugcagccucagaacgguagauguacgacugauggcguauugcuggggaccacacaacuaagcccaguuaauauuugcacuuuuaggggagacgugacccauaucacaggcucucggaacuacaccaugaaucucgcaucccagaacuggucaaauuaugauccgacggaggaaauacccgcuccucuggguacuccagacuucgucgggaagauucagggagugcuuacacagaccacucgcacagacggcagcacccgaggccacaaggccacggucuacaccgggagugcugauuuugcccccaagcugggaagagugcaauucgagacagacacugaucaugacuuugaagcaaaccagaauaccaaauucacaccuguuggugugauccaggauggcucuacuacccacaggaacgagccacaacaguggguauugcccuccuacagcgggcggaauacaccgaacguccaccucgccccugcuguggcgccaaccuuucccggagaacagcuguuauucuuucguucgacuaugccuggcuguucugguuaucccaauauggaccuggauugccuccuuccacaggaguggguucaauacuucuaucaggaggcagccccugcucaguccgacguggcccuguugcgcuuugucaaccccgauacggggagagugcuauucgaauguaagcugcauaaaucaggcuacguaacaguggcacacaccggacagcaugaccucguuauuccaccgaauggcuauuuuagguucgauaguugggucaaccaauucuacacucuggccccuauggggaacggaaccggucggcgacgcuga

SEQ ID NO: 21220 - RNA, 1617 nt, Artificial Sequence
  derived and/or modified sequence opt3 from VP1__Norovirus_and/or_Norovirus-like__KT202796
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggaccuggauugccuccuuccucaggaguggguucaauacuucuaucaggacgcagcccccgcucagucggauguggcccuguugcgcuuugucaacccagacacgggcagagugcuauucgaguguaagcugcauaaaucuggauacguaacaguggcacacaccggccagcaugaucucguuauuccgccuaauggguauuuuagguucgacuccugggucaaccaauucuacacucuggcccccaugggaaacgguaccggccggcgacgcuga

SEQ ID NO: 21221 - RNA, 1617 nt, Artificial Sequence
  derived and/or modified sequence opt3 from VP1__Norovirus_and/or_Norovirus-like__AB933751
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaacaaucagaacaccaaauucacacccgucggugugauccaggacggcucuacuaccccgaggaaugaaccucaacaguggguuuugccauccuacagcgggcggaacauccauaaugugcaccucgcccccgcaguagccccuacauuucccggagagcagcuguuauucuuucguucgaccaugccaggcuguucugguuauccuaacauggaucuggacugccuccuuccccaggaauggguccaauacuucuaucaggaggcugcgccagcacaguccgauguggcccuguugcgcuuuguuaacccggacacugggagagugcuauucgaguguaagcugcacaaaucaggcuacgucacgguggcucauacaggacagcacgaucucguaauuccucccaauggcuauuuuagguucgacaguugggugaaccaauucuacacccuggccccaauggggaauggaacuggucggcgacgcuga

SEQ ID NO: 21222 - RNA, 1617 nt, Artificial Sequence
  derived and/or modified sequence opt3 from VP1__Norovirus_and/or_Norovirus-like__KM514078
augaagauggccagcuccgacgcuaaccccucugauggcucagcagccaaucuggugccugaggucaacaaugaaguucucgcgcuugagccagugguaggggcugccaucgcagccccgguggcuggacagcaaaacgucauugaccccuggauaagaaauaacuucgugcaggcaccugguggcgaauuuaccguuaguccaaggaaugcccccggggagauccuguggagcgcuccuuugggaccagauuuaaaccccuaccugucccaccuagcccggauguauaauggcuacgcggguggguucgaagugcaggucauucucgcaggaaacgccuuuacagcuggcaaagugaucuucgccgcaguaccuccaaauuuuccgacugagggccugucucccucgcagguuacgauguucccucauauuguggucgacgugcgccaacuugagccagugcugauccccuugccugauguccgaaacaauuuuuaucacuacaaccagucaaaugacccaaccauaaagcucaucgcuaugcuguauacaccccugcgugccaacaacgcgggggaugacguuuucacugugagcugcagaguacucaccaggccgaguccugauuuugacuucaucuuuuuagugcccccaacagucgaaucccggaccaaaccuuucucugugcccguucugacuguggaggaaaugacaaauagccgcuuuccaauuccccuugagaaguuguucaccggaccuuccucagccuucgucgugcagccacagaacgguagauguacgacugauggcguacugcuagggaccacacaacucaguccgguuaauauuugcacuuuuaggggagacgugacccauaucacaggcagccggaacuacaccaugaaucuggcaucucagaacugguccaauuaugaucccacggaggaaauaccugcuccacuugguacucccgacuucgucgggaaaauucagggaaugcugacacagaccacucgcacagacggcucaacccgaggccacaaggccacgguguacaccgggagcgcugauuuugccccuaaguugggaagaguccaauucgagacagacacugaucaugacuuugaagcaaaccagaauaccaaauucacaccaguggguguuauccaggauggcaguacuacccacaggaacgagccccaacagugggugcucccgucuuacuccgggcggaauacaccuaacguacaccuggccccagcugucgcgcccaccuuuccuggagaacaguuacuguucuuucguagcacuaugcccggcuguucggguuauccaaauauggaccucgauugccuucugccucaggagugggugcaauacuucuaucaggaggcagcccccgcucagucugacguugccuugcuacgcuuugugaacccagauacggggagaguccuguucgaauguaagcuccauaaauccggcuacgugacaguagcacacaccggacagcaugaccuggugauuccgccuaauggcuauuuuagguucgauucauggguuaaccaauucuacacucuugcccccauggggaacggaaccggucggcgacgcuga

SEQ ID NO: 21223 - RNA, 1617 nt, Artificial Sequence
  derived and/or modified sequence opt3 from VP1__Norovirus_and/or_Norovirus-like__KM198569
augaagauggccagcaacgacgcuaaucccuccgauggcucugcagccaaccuggugccugaggucucaaaugaaguuauggcgcucgagccaguggcuggggccgcaaucgccgcuccgguagcaggacagcaaaacgugauugaccccuggauaagaaauaacuucguccaggccccugguggcgaauuuaccgugaguccaaggaaugcucccggggagauccuuuggagcgccccucugggaccagauuugaaccccuacuuaucccaccuggcgcggauguauaauggcuacgccgguggguucgaaguucaggugauucuagcaggaaacgcuuuuacagccggcaaaaucauuuucgcagcugucccuccaaauuuuccgacugagggccucucucccucacaggugacgauguucccucauaucauaguagacguucgccaacuggagccagugcuuaucccccugccugauguccgaaacaauuuuuaucacuacaaccagaccaaugacucgacaauuaaguugaucgccaugcucuauacuccacugcgugcgaacaacgccggggaagauguguucaccgugagcugcagaguccugacaaggcccaguccggacuuugauuucauuuuucucguuccucccaccguggagucccggacuaaaccauucacaguaccuaucuuaaccguggaagagaugacuaauucucgcuuucccauaccacuggagaaacuuuucacgggacccagcggugcauucgucgugcagccucagaacggcagauguaccacagacgggguuuugcugggaacuacccaacuauccccagugaauauuugcacauuuaggggcgaugucacccauaucgcugguucacggaacuacacgaugaaucucgccagucugaacuggaauaacuaugacccgacugaagagauucccgcuccucuugggacaccagauuucgugggaaagauccagggcguacugacccagacuacaaagggcgacgggagcacccgcggacacaaggccacgguuuacaccgguucugcacccuuuacaccuaaauugggcuccgugcaguucucaacugacaccgaaaaugauuuugagacacaucaaaacacuaaguucaccccagucggggugauccaggacggaggcacaacccaccgaaaugaaccccagcaauggguccucccgagcuacagugguagagaugugcacaacguucaucuggccccugcuguggcgccaacuuuucccggggagcaguuacuguucuuuaggucuacgaugccuggcuguuccggauaucccaauauggaccucgauugccuucugccacaggaguggguacagcacuucuaccaagaagcagccccugcucagagcgacgucgccuugcuacgguuugugaaccccgauacaggccguguucuguucgaguguaaacuccauaagucgggguaugugaccgucgcacacacuggacagcacgaccuggugauuccaccgaaugguuacuuucgcuucgauucuuggguaaaccaguucuauacccuugccccuaugggcaacgggacaggaagaaggcgguga

SEQ ID NO: 21224 - RNA, 1617 nt, Artificial Sequence
  derived and/or modified sequence opt3 from VP1__Norovirus_and/or_Norovirus-like__KF768522
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaauucauaucagcggcucucggaacuacacaaugaaucucgccucccagaacuggaacucauaugaucccaccgaggaaauuccugcaccacuggguacgcccgacuucguugggaagauccagggagugcuuacucagacaacccgcacuaauggcagcacacgaggccacaaggcuaccgucuacacggggagugccgacuuuucuccuaagcugggaagagugcaauucgcuaccgauacagacaaugauuuugagacuaaccagaauaccaaauucacaccagucggugugauccaggacggcuccacuacccccaggaacgaaccgcaacaguggguuuugccuagcuacucggggcggaauauucauaacgugcaccucgccccagcaguagcccccacauuuccuggagagcagcuguuauucuuucguucuaccaugcccggcuguuccgguuauccaaauauggaucuggacugccuccuuccucaggaauggguccaauacuucuaucaggaggcugcgcccgcacagucagauguggcccuguugcgcuuuguuaacccagacacugggagagugcuauucgaguguaagcugcacaaaaguggcuacgucacgguggcucauacaggacagcacgaucucguaauaccgccuaacggcuauuuuagguucgacagcugggugaaucaauucuacacccuggcccccauggggaacggaacuggucggcgacgcuga

SEQ ID NO: 21225 - RNA, 1617 nt, Artificial Sequence
  derived and/or modified sequence opt3 from VP1__Norovirus_and/or_Norovirus-like__KF060120
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggaacgccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaacucucgcuuuccaaucccccuggagaaacuuuucacgggaccuagcuccgcguucguugugcagccacagaaugguaaguguacuaccgauggcgucuugcuggggacaacucaacuaucaccggugaacauaugcaccuuuagaggagacguaacacauauucccggcaguaggaauuacaccaugaaccucgccagccagaauuggaacucuuaugauccuacggaggaaaucccagcaccccuggguacuccugacuucguugggaagauucagggagugcuuacacagaccacucggacaaauggcuccacccgcggccacaaggcuacggucuacaccgggucagccgacuuuagcccaaaacugggacgagugcaauucgcuacagauacugacaacgauuuugagaccaaucagaacacaaaguucacucccgucggugugauccaggacggcaguaccacaccgagaaaugaaccucaacaguggguuuugccaucuuacuccgggaggaacauccauaaugugcaccucgcccccgcaguagccccuaccuuucccggagagcagcuguuauucuuucggagcacuaugccaggcuguucggguuauccuaacauggaucuggacugccuccuuccccaggaauggguccaauacuucuaucaggaggcugcgccagcacagucugauguggcccuguugcguuuuguuaacccggacacggggcgcgugcuauucgaguguaaacugcacaaguccggcuacgucacaguggcucauaccggacagcacgaucucguaauuccucccaauggcuauuuuagauucgacucaugggugaaccaauucuacacucuggccccaauggggaauggaaccgguaggcggcgauga

SEQ ID NO: 21226 - RNA, 1617 nt, Artificial Sequence
  derived and/or modified sequence opt3 from VP1__Norovirus_and/or_Norovirus-like__KF060102
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggaaacgugacccauaucacaggcagccggaauuacaccaugaaccucgcaucucagaauuggaacaauuaugaccccacggaggaaauaccugcuccacuggguacucccgauuucgucgggaagauucagggagugcuuacacagaccacucgcacagacggcuccacccgaggccacaaggccacggucuacaucgggucagcugacuuugccccuaagcugggaagagugcaauucgagaccgauacagaccaugauuuugaagcaaaccagaauacuaaauucaccccaguuggugugauucaggacggcgggacaacucacaggaacgagccccaacaguggguauugccgagcuacaguggacggaauacccacaacguccaucucgccccugcuguggcgccaacauuucccggcgaacagcuguuauucuuucguucuaccaugccugguuguuccggguaucccaauauggaucuggacugccuccuuccacaggaguggguucaauacuucuaucaggaggcagccccugcucagagcgauguggcccuguugcgcuuugucaaccccgacacuggcagagugcuauucgaauguaagcugcacaaaucgggauacguaacgguggcacauacaggccagcacgaucucguuaucccaccgaacggguauuuuagguucgacucuugggucaaucaauucuacacccuggccccuaugggaaacgguacuggccggcgacgcuga

SEQ ID NO: 21227 - RNA, 1617 nt, Artificial Sequence
  derived and/or modified sequence opt3 from VP1__Norovirus_and/or_Norovirus-like__KF060088
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggaaugcuuacacagaccacucgcacagacggcagcacccgaggccacaaggcuacgguguacaccgggagugccgauuuuucuccuaagcugggaagaguccaauucgcuacagacacugauaaugacuuugugaccaaucagaacacaaaauucacuccagucggugugauccaggauggcuccaccacacccaggaaugagccgcaacaguggguuuugccuagcuacucggggcggaacacccauaaugugcaccucgccccagcaguagcccccacuuuuccuggagaacagcuguuauucuuucguucuacgaugcccggcuguuccgguuauccaaacauggaccuggauugccuccuuccucaggaguggguccaauacuucuaucaggaagcugcgcccgcacagucagacguggcccuguugcgcuuuguuaauccagauacagggagagugcuauucgaguguaagcugcacaaaaguggcuacgucaccguggcucauacuggacagcacgaccucguaaucccgccuaacggcuauuuuagguucgauagcugggugaaccaauucuacacccuggcccccauggggaauggaacaggucggcgacgcuga

SEQ ID NO: 21228 - RNA, 1617 nt, Artificial Sequence
  derived and/or modified sequence opt3 from VP1__Norovirus_and/or_Norovirus-like__KF060025
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucgccgaucagaauaccaaauucacaccaguggguguuauccaggacggcuccacuacccccaggaacgagccgcaacaguggguguugccuagcuacucggggcggaauacacauaacguacaccucgcaccagccgucgcucccaccuuuccuggagaacagcuguuauucuuucguucuacuaugcccggcuguuccgguuauccaaauauggaucuggacugccuccuuccucaggagugggugcaauacuucuaucaggaagcggcacccgcccagucagauguugcucuguugcgcuuugugaacccagacacggggagaguccuauucgaguguaagcugcacaaaaguggcuacgugacaguagcccauaccggacagcacgaucucgugaucccgccuaauggcuauuuuagguucgacagcuggguuaaccaauucuacacucuggcacccauggggaacggaaccggucggcgacgcuga

SEQ ID NO: 21229 - RNA, 1617 nt, Artificial Sequence
  derived and/or modified sequence opt3 from VP1__Norovirus_and/or_Norovirus-like__KC517378
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugaugucgggaacaauuuuuaucacuacaaccagucaaaugacccaaccauaaaguugaucgcuaugcucuauacaccccugcgagccaacaacgcgggagaugacguuuucacugugagcugccguguacugaccagaccgaguccugauuuugacuucauuuuucucgugcccccaacagucgaauccaggaccaaaccuuucucugugcccguuuuaacuguggaggaaaugacaaauagccgguuuccaaucccccuggagaaacuuuucaccgguccuuccucagccuucgucgugcagccacagaacggccgcuguacgacugaugggguauugcugggaaccacacaacuaaguccgguuaauauuugcacuuuuagaggcgacgugacccauaucacagguagcaggaacuacaccaugaaucucgcaucucagaacuggaauaacuaugaucccacggaggaaauaccugcuccacuggggacucccgacuucgucggaaagauucagggcgugcuuacacagaccacucggacagacggcuccacccgcgggcacaaggccacggucuacaccggaucagcugauuuugccccuaagcugggucgagugcaauucgagacagacacugaucaugacuuugaagcaaaucagaacaccaaauucacaccaguuggcgugauccaggaugggggaacuacccacagaaaugagccccaacaguggguauugccgagcuacaguggcaggaacacacacaauguccaucucgccccugcuguggcgccaaccuuucccggugaacagcuguuauucuuucggucuacuaugccuggguguuccggcuaucccaacauggaccuggauugccuccuuccacaggaguggguucaauacuucuaucaggaggcagccccugcucagagcgacguggcccuguugcguuuugucaaucccgauacgggacgcgugcuauucgaauguaagcugcacaaaucgggcuacguaacaguggcacauaccgggcagcacgaccucguuauuccaccgaacggauauuuuagauucgauucuugggucaaccaauucuacacucuggccccuauggguaauggcaccgggaggcggcgauga

SEQ ID NO: 21230 - RNA, 1617 nt, Artificial Sequence
  derived and/or modified sequence opt3 from VP1__Norovirus_and/or_Norovirus-like__JX459640
augaagauggccagcuccgacgcuaaccccucugauggcucaaccgcacaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucauaguugacgugcgccaacuggagccaguccuuaucccccugccugaugugcgaaauaacuuuuaucauuacaaucagucaaacgacccaacaauuaaguugaucgcaaugcucuauacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacacauucccggcagccggaauuacaccaugaaccucgccucucagaauuggaacuccuaugauccuacggaggaaaucccagcaccccuggguacuccugacuucguugggaagauucagggagugcuuacacagaccacucgcacaaauggcucaacccgaggccauaaggcuacggucuacaccgggagcgccgacuuuaguccaaagcugggaagagugcaauucgcuacagauacugacaacgauuuugagaccaaucagaacacaaaauucacucccgucggugugauccaggacggcucuaccacaccgaggaaugaaccucaacaguggguuuugccauccuacagcgggcggaacauccacaaugugcaccucgcccccgcaguagccccuaccuuucccggagagcagcuguuauucuuucguucgacuaugccaggcuguucugguuauccuaacauggaucuggacugccuccuuccccaggaauggguccaauacuucuaucaggaggcugcgccagcacaguccgauguggcccuguugcgcuuuguuaauccggacacggggagagugcuauucgaguguaagcugcauaaaucaggcuacgucacaguggcucacaccggacagcaugaucucguaauuccucccaacggcuauuuuagguucgacaguugggugaaccaauucuacacucuggccccaauggggaauggaaccggucggcgacgcuga

SEQ ID NO: 21231 - RNA, 1617 nt, Artificial Sequence
  derived and/or modified sequence opt3 from VP1__Norovirus_and/or_Norovirus-like__JQ613512
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaagauguguucaccgucaguugcagaguucugacaaggcccuccccggacuuugauuucauuuuucucgugccucccaccguagagucucggacuaaaccauucacagugccuaucuuaaccgucgaagagaugacgaauagccgcuuucccauaccacuggagaaacuuuucacuggacccuccggugcguucgugguucagccucagaacggcagauguaccacagacgggguguugcugggaacuacccaacuaucaccagucaauauuugcacauuuaggggcgaugugacccauaucgccgguagucggaacuacacgaugaaucucgcaagccugaacuggaauaacuaugacccgacugaagagauucccgcuccucuugggacaccagauuucguaggaaagauccagggcguucugacccagacuacaaagggcgacgggucuacccgcggacacaaggccacgguguacaccgguuccgcucccuuuacaccuaaauugggcucaguccaguucagcacugacaccgaaaaugauuuugagacacaucaaaacacuaaguucaccccagugggggucauccaggacggaaguacaacccaccgaaaugaaccccagcaaugggugcucccgucuuacuccggcagaaacguucacaaugugcaucuggccccugcaguagccccaacuuuucccggugagcaguuacuguucuuuaggagcacgaugccuggguguucgggcuaucccaacauggaucucgacugccuucugccacaggaguggguccagcacuucuaccaagaagcugcgccugcacagucugauguggccuugcuacgguuuguuaaucccgacacaggacgugugcuguucgaguguaaacuccauaaguccggcuaugucaccguggcucacacugggcagcacgaucugguaauuccaccgaacggauacuuucgcuucgacgccugggugaaccaguucuauacccuugcaccuauggguaauggcacagggagaaaaagguga

SEQ ID NO: 21232 - RNA, 1617 nt, Artificial Sequence
  derived and/or modified sequence opt3 from VP1__Norovirus_and/or_Norovirus-like__HQ005299
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccugucucggauguauaauggcuacgcugguggguucgaagugcaggucauucuagccggaaacgcguuuacugcaggcaaaaucauuuucgccgcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacgggaccuucaagugccuucguugugcagccacagaacgguagauguacuaccgauggcgucuugcuggggacaacucaacuaagcccggugaauauaugcaccuuuaggggagacguaacacauauucccggcucucggaacuacaccaugaaucucgcgucccagaacuggaacucauaugauccuacggaggaaaucccagcaccccuggguacuccugacuucguugggaagauucagggagugcuuacacagaccacucgcacaaauggcagcacccgaggccacaaggccacggucuacaccgggagugcugacuuuucuccaaagcugggaagagugcaauucgccacagauacugacaaugauuuugagaccaaccagaauacaaaauucacucccgucggugugauccaggacggcuccaccacaccgaggaacgaaccucaacaguggguuuugccaagcuacucggggcggaauauccauaacgugcaccucgcucccgccguagcaccuaccuuucccggagagcagcuguuauucuuucguucuacuaugccaggcuguuccgguuauccuaauauggaucuggacugccuccuuccccaggaauggguccaauacuucuaucaggaggccgcuccagcgcagucagauguggcacuguugcgcuuuguuaacccggacacggggagagugcuauucgaguguaagcugcacaaaaguggcuacgucacaguggcccauaccggacagcacgaucucguaauuccucccaacggcuauuuuagguucgacagcugggugaaucaauucuacacucuggcuccaauggggaacggaaccggucggcgacgcuga

SEQ ID NO: 21233 - RNA, 1617 nt, Artificial Sequence
  derived and/or modified sequence opt3 from VP1__Norovirus_and/or_Norovirus-like__AB541312
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuguauucucgauuuacccccaaccguggaaucccggacuaaaccuuucucuguacccauccugacaguggaggaaaugaccaauagccgcuuuccaauaccccuugagaaguuguucacgggaccuuccucagcguuugucgugcagccacagaacgguagaugcacuaccgacggcguucugcuagggacaacucaacucaguccggugaauauuuguaccuucaggggagaugucacacauaucaccggcagccggaacuacacgaugaaucuggccacucagaacuggaacucuuaugaccccacagaggaaauuccugcaccacuugguacccccgacuucguggggaaaauccagggaguacugacucagacaacccgcgcugauggcuccacgcgaggccacaaggccaccguuuacacagggucagcugacuuugccccuaaguugggaagagugcaauucgcaacugauaccgacaaugauuuugacgccaaucagaacacaaaauucacuccagucggugugauccaggauggcgacaccgcucauaggaaugagccccaacaguggguccucccgagcuacagugggcggaacucucacaaugugcaccuggcgccugcaguugccccaacauuucccggagaacaguuacuguucuuucguuccaccaugccuggcugcagcgguuaucccaacauggaucucgacugucuucugccacaggagugggugcaauacuucuaucaggaagcugccccugcacagucggauguagccuugcuacgcuuugucaaucccgacacugggagagugcuguucgagugcaagcuccauaaaucuggcuacguuacgguggcucacacaggacagcaugaccuggucauuccaccgaacggcuauuuuagguucgauuccugggugaaccaauuuuacacccuugccccuauggggaauggaacuggucggcgacgcuga

SEQ ID NO: 21234 - RNA, 1617 nt, Artificial Sequence
  derived and/or modified sequence opt3 from VP1__Norovirus_and/or_Norovirus-like__AB541275
augaagauggccagcuccgacgcuaaucccccugauggcucugcagccaaccuggugccagaggucaacaaugaaguuauggcgcucgagccggugguaggggcugccaucgcagcccccguggcuggacagcaaaacgucauugacccuuggauaagaaauaacuucgugcaggcaccagguggcgaauuuaccguuucacccaggaaugccccuggggagauccuuuggagugcuccacugggacccgauuugaacccuuacuuaagccaccuggcccggauguauaauggcuacgcggguggguucgaagugcaggucauucuagcaggaaacgccuuuacagcuggcaaaaucauuuucgccgcagugccaccgaauuuucccacugagggccucuccccuucucagguaacgauguucccacauaucauaguugacgugcgccaacuggagcccguccuuaucccucugccagaugugcgaaacaauuuuuaucacuacaaccagucgaaugacucaaccauuaaguugaucgcuaugcucuauacaccccugcgugccaacaacgcgggggaagauguguucacugucagcugcagaguucugaccaggccgaguccugacuuugauuucauuuuucucgugcccccaacaguagagucccggaccaaaccuuucacugugcccaucuuaacagucgaagagaugaccaauucucgcuuuccaauaccccuggagaaacuuuucacgggaccuagcggugccuucgugguucagccacagaacggcagauguacuaccgacgggguguugcugggaacaacucaacuauccccggucaauauuugcaccuuuaggggcgaugugacacauaucgcagguucacggaguuacaccaugaaccucgcuagccugaauuggaacaauuaugaccccacggaagagauuccugccccacuugggacucccgauuucguaggaaagauccagggcaugcugacacagaccacuaagggcgacgggucuacacgcggacacaaggcuaccguuuacacggguuccgccccuuuuaccccaaaauugggcucagugcaguucagcacagacacugaaaacgauuuucaaacccaucagaauacaaaguucacucccgucggggugauccaggacggaaguaccacacaccgaaacgagccgcaacaguggguccucccuucuuacuccggcagagaugugcacaauguucaucuggcaccagccguggcucccaccuuuccuggugaacaguuacuguucuuuaggagcacuaugcccggguguucgggcuauccaaacauggaccucgauugccuucugccucaggaguggguacaacacuucuaccaggaggcggcacccgcccagucugacgucgcuuugcuacgguuugugaauccagauacgggacguguucuguucgaauguaaacuccauaaguccggcuaugugacagucgcccacaccgggcagcacgaccuggugauuccgccuaacggauacuuucgcuucgauucauggguaaaucaauucuauacucuugcacccauggguaacggcaccgggagaaggcgguga

SEQ ID NO: 21235 - RNA, 1617 nt, Artificial Sequence
  derived and/or modified sequence opt3 from VP1__Norovirus_and/or_Norovirus-like__AB303930
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucgugcuagcgggaaacgcauuuacggccggcaaaauuaucuucgcugccguaccuccaaauuuuccgaccgagggccucucccccucucagguuacaauguucccucauauuaucguggacguccgccaacuggagccagugcuuauaccccugccugaugugcgaaacaauuuguaucacuacaaccagucgaaugacccaacuaucaagcucauugcaaugcuguauacaccccugcgugcuaacaacgccggggaagaugucuuuaccguuucaugcagagugcucaccaggccgagcccugacuucgauuuuaucuucuuaguacccccaacuguggagagucggacaaaaccuuuuaccguccccauucugacgggagaagagaugacuaauucccgcuucccaaucccccuugagaaguuguuuaccgguccuucuggcgcguucgugguucagccacagaacgggagauguacaacugacggagugcugcuaggcaccacacaacuccugccggucaauauaugcaccuucaggggugaugugacgcauauugccgggacucacaacuacacaaugaaucuugcaagccagaacuggaauaacuaugaccccaccgaagagaucccugcuccacugggaacucccgauuuuguaggccggauucagggcauguugacacagaccacgcgcggggacggauccacccgaggucauaaagccacaguuucaacuggcgacgugcacuucaccccuaagcucgggaguauccaauuuaauacagauacuaacaaugacuucgaaaccggacagaacacaaaguuuaccccagucggcgugguccaggaugguaaugggacucaccaaaacgagccccagcagugggugcugccgagcuacucuggcagaacgucccauaauguucacuuagcuccugccguggcaccaacauuccccggagaacagcugcucuuuuucaggucaaccaugccuggcuguagcggguaccccaacaugaaccuugacugccuguugccacaagaguggguacagcauuuuuaucaggaggccgcuccugcgcagagugaugucgcacuacugcgguucgugaaucccgacacuggacguguucucuuugaauguaaacugcacaagucugguuacgugaccgucgcccacacaggccaacaugaucuugugaucccaccgaacggguauuuccgcuuugacuccuggguaaaucaguucuacacccuggcuccuaugggaaacggcacugguagaaggcgguga

SEQ ID NO: 21236 - RNA, 1617 nt, Artificial Sequence
  derived and/or modified sequence opt3 from VP1__Norovirus_and/or_Norovirus-like__AY485642
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaccucaccuggcucggauguauaacggcuacgccgguggguucgaagugcaggucauucuagcgggaaaugcauuuacugccggcaaaaucauuuucgcugccgugccaccgaacuuucccacggagggccucagcccuucccagguaaccauguucccacauaucauaguugacgugcgccaacuggagcccguccuuaucccucugccagaugugcgaaauaacuuuuaucacuacaaucagucuaacgaccccacaauuaaguugaucgcaaugcucuauacuccgcugcgugcuaacaaugccggggaagauguguucaccgucucgugcagaguucugacaaggccuucacccgacuuugauuucauuuuucucgugccaccuaccguagagagccggacuaaacccuucacagugccaaucuuaaccgucgaagagaugacgaacagucgcuuucccauaccucuggagaaacuuuucacuggaccauccggugcguucgugguucagccgcagaauggcagauguaccacagacgggguguugcugggaacuacccaacuaucucccgucaacauuugcacauuuaggggcgaugugacccauaucgccgguacgcacaauuacacuaugaaccucgcaagccagaauuggaacaauuaugggccuacagaagagauuccagcuccccugggaaccccugacuucguaggccggauccagggcaugcuuacucagacaacccgcggggauggauccacgcgaggucauaaggccaccguuucaacaggcgacgugcacuuuacuccaaagcuggggaguauccaauucaacaccgacacaaauaacgauuuugaaacuggacagaauaccaaguucacacccgucggcgugguccaggacgguaacgggacccaccaaaaugagccgcagcaguggguguugccuagcuacucuggcagaacuggacauaacguucaccucgcuccagccguggcacccacguuuccuggcgaacagcuguuauucuuuagguccacaaugcccggguguucaggauacccaaacaugaaucuggauugccuccuuccucaagaguggguacagcauuucuaucaggaggccgcucccgcgcagagcgacgucgcacuguugcgguuugugaacccagauaccggucguguucuauucgaauguaaacugcacaagaguggcuacgugacugucgcccacaccgggcaacaugaccucgugauuccgccuaauggauauuuucgcuucgauucuuggguaaaccaguucuacacacuggcucccaugggcaaugguaccgggagaaggcgguga

SEQ ID NO: 21237 - RNA, 1617 nt, Artificial Sequence
  derived and/or modified sequence opt3 from VP1__Norovirus_and/or_Norovirus-like__KX514343
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcguacuaacaaugccggggaugacguguucaccgucagcugcagaguucugacaaggcccaguccggauuuugacuucauuuuucucgugccucccaccguagaaucccggucuaaaccauucagcgugccugucuuaacuguggaggaaaugacaaacucccgcuuucccgcgacccuggauaaacuuuucacgggaccaucaaguacuuucguugugcagccccagaaugguagauguaugaucgacggcgucuugcuggggaccacacaacuaagcccugugaacauaugcacuuuuaggggagauguaacccagucuggcaauacaaagauuuacaccaugaaccucgccuccccaaauuggaacaauuaugacccgacggaggagauccccgcaccucuggguacuccagacuucguugggaagauucagggaaugcuuacacagaccacuaagggcgaaggcucaacacgggggcaucgcgcuaccguguacgucggaagcgccaacuacgcucccaaacugggucgagugcaauuugagacggauaccacagacgauuuggacgcccaccagaauacuaaguucaccccugucggcgugguucagaguggggaaucuccaaaaggauccgagccccaacagugggugcucccgagcuauucgggcagagauacaccuaacguacaucuggcaccagccgucgcucccacuuuuccuggugaacaguuacuguucuuuaggucuaccauccccggguguggcggacacccaaauaugaaccucgacugccuucugccucaggagugggugcaacacuucuaccaggaggcggcacccgcccaguccgauguugcuuugcuacgguuugugaauccagacacaucacguguccuguucgaauguaagcuccauaaaaguggcuaugugaccguagcccacacugggcaguacgaucuggugcuuccgagcaacggauauuuucgcuucgacuccuggguuaaccaauuuuacacgcuggcaccuauggguaauggcacagggagaaggcgguga

SEQ ID NO: 21238 - RNA, 1617 nt, Artificial Sequence
  derived and/or modified sequence opt3 from VP1__Norovirus_and/or_Norovirus-like__KX514274
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaaggacucaaccauuaaauugaucgcuaugcucuauacaccacugcgugccaacaacgcgggggaugacguguucacugucagcugcagaguucugaccaggcccaguccggauuuugacuucauuuuucucgugccucccacaguagaaucccggucuaagccauucagcgugccugucuuaaccguggaggaaaugacuaauucccgcuuucccguuacacuggauaaacuuuucaccggaccaucaaguacgaucgugguccagccccagaacgguagauguacuauagacggcguguugcuggggaccacacaacuaagcccuguaaauauuugcacuuucaggggagauguuacccauccacgggacucuacaaucuacaccaugaaccucgccuccccgaauuggaacacguaugaccccacugaggagauuccugcaccacugggcacacccgauuuuguggguaagauccaggggaugcuuacccagacuacaaagggagcuggcucaacccgcggccaccgagccacggucuacguggggagcgcuaauuacgccccuaaacugggaagaguccaguucgaaaccaacacaagugacgauuuggacgcacaucaaaauacuaaguuuaccccaguggguguuauccagggcggggagucugcccacagguccgaaccccagcaaugggugcucccgagcuauucgggacgggauauuccuaacguacaccuggcuccagcggucgcacccacauucccuggcgagcaguuacuguuuuuccguucuacuauacccgguugugggggccauccaaauauggaccucgauugccuucugccucaggaaugggugcagcacuuuuaccaagaggccgcucccgcccaguccgacguugcauugcuacgcuucgugaacccagauaccucaagaguccuguuugaguguaaacuccauaagaguggauaugugacaguagcccacaccggccagcacgaccuggugaucccgccuaauggguacuucagguuugauagcuggguuaaccaguucuauacucuugcucccaugggaaaugguacgggccggaaacgauga

SEQ ID NO: 21239 - RNA, 1617 nt, Artificial Sequence
  derived and/or modified sequence opt3 from VP1__Norovirus_and/or_Norovirus-like__KX514175
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuaagauuuacaccaugaaucucgcauccccgaacuggaauaacuaugaccccacagaggagaucccugcuccacugggcacccccgauuucguugguaagauucaggggaugcuuacgcagacuacaaagggagaaggcucaacccgcggccaccgagccacuguguacgucgggagcgcuaauuacgccccuaaacugggaagagugcaguuugagacagacaccacggaugacuuggaugcacaucaaaacaccaaguucacaccagucggugugguucagggcggggaaagucccaaaggaucugagccgcagcaaugggugcucccuuccuauagcggcgccaauacuuuuaacguacaccuggcuccagcggucgcacccaauuucccuggugaacaguuacuguuuuucaggucgacccuccccggguguggcggacacccaaacauggaccuugauugccuguugccucaggagugggugcagcauuuuuaccaagaggccgcucccgcccagucugacguugcacuacugcgguucgugaauccagauacaucccguguccucuuugaauguaagcugcacaaaucaggcuaugugacuguagcccauaccgggcagcacgaccuugugaucccgccuaacggauacuuccgcuuugauaguuggguuaaccaguucuauacacuggcucccauggguaauggcaccgggagaaagagguga

SEQ ID NO: 21240 - RNA, 1617 nt, Artificial Sequence
  derived and/or modified sequence opt3 from VP1__Norovirus_and/or_Norovirus-like__KX354093
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggucaagcuaugaucccacggaggaaauuccugcaccacuggguacucccgacuucguagggaagauccagggaguucuuacacagaccacaaguacuaauggcucuacccggggccauaaggcuacgguguacaccggguccgccgacuuuagcccuaagcugggacgcguccaauucgcuacagauacuaacaaugacuuugagaccaaccagaauacaaaauucacuccagugggugucauccaggauggcucgaccacaccccgaaacgaaccgcaacaguggguguugccuucuuacuccgggagaaauauucacaacguucaccucgccccagcaguggcccccaccuuuccuggagagcagcuguuauucuuuaggucaacuaugcccggcuguagugguuauccaaauauggaccuggauugccuccuuccucaggaauggguacaauacuucuaucaggaggcugcgcccgcacagagcgacgucgcccuguugcgguuugugaacccagauacggggcguguucuauucgaguguaagcugcauaaauccggcuacgugacagucgcucacaccggacagcaugaccucgugauaccgccuaacggcuauuuucgcuucgauucuuggguaaaucaauucuacacucuggcccccauggggaacggaaccgguagaaggcgguga

SEQ ID NO: 21241 - RNA, 1617 nt, Artificial Sequence
  derived and/or modified sequence opt3 from VP1__Norovirus_and/or_Norovirus-like__KX354003
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauacccauaacgugcaccucgccccagcaguagcccccacuuuuccuggagagcagcuguuauucuuucguucuacgaugcccggcuguuccgguuauccaaauauggaucuggacugccuccuuccucaggaauggguccaauacuucuaucaggaggcugcgcccgcacagucagauguggcccuguugcgcuuuguuaacccagacacagggagagugcuauucgaguguaagcugcacaaaaguggcuacgucaccguggcucauacuggacagcacgaucucguaaucccgccuaacggcuauuuuagguucgacagcugggugaaucaauucuacacccuggcccccauggggaacggaacaggucggcgacgcuga

SEQ ID NO: 21242 - RNA, 1617 nt, Artificial Sequence
  derived and/or modified sequence opt3 from VP1__Norovirus_and/or_Norovirus-like__KR131778
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucaccgaucagaauacaaaauucacuccaguggguguuauccaggacggcuccaccacacccaggaacgagccgcaacaguggguguugccuagcuacucggggcggaauacccauaacguacaccucgccccagcagucgcccccacuuuuccuggagaacagcuguuauucuuucguucuacgaugcccggcuguuccgguuauccaaauauggaucuggacugccuccuuccucaggagugggugcaauacuucuaucaggaagcugcgcccgcacagucagauguugcccuguugcgcuuugugaacccagacacagggagaguccuauucgaguguaagcugcacaaaaguggcuacgugaccguagcucauacuggacagcacgaucucgugaucccgccuaauggcuauuuuagguucgacagcuggguuaaccaauucuacacccuggcccccauggggaacggaacaggucggcgacgcuga

SEQ ID NO: 21243 - RNA, 1617 nt, Artificial Sequence
  derived and/or modified sequence opt3 from VP1__Norovirus_and/or_Norovirus-like__AB972468
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaucccacuggagaaacuuuucaccggacccucaagugccuucgucgugcagccucagaacgguagauguacgacugauggcguauugcuggggaccacacaacuaagcccaguuaauauuugcacuuuuaggggagacgugacccauaucacaggcucucggaacuacaccaugaaucucgcaucccagaacuggucaaauuaugauccgacggaggaaauacccgcuccucuggguacuccagacuucgucgggaagauucagggagugcuuacacagaccacucgcacagacggcagcacccgaggccacaaggccacggucuacaccgggagugcugauuuugugcccaagcugggaagaguucaauucgagacagacacugauagggacuuugaagccaaccagaauaccaaauucacaccuguggguguaauccaggauggcucuacuacccaucggaacgagccacaacagugggucuugcccuccuacagcgggcguaauacaccgaacgugcaccucgccccugcaguugcuccaaccuuucccggagaacagcuguuauucuuucgcucgacuaugccuggcuguucugguuaucccaauauggaccuggauugccuccuuccacaggagugggugcaauacuucuaucaggaggcggccccugcacaguccgacgucgcucuguugagauuugugaaccccgauacggggaggguacuauucgaauguaagcugcacaaaucaggcuacgugacaguugcccauaccggacagcacgaccucgucauuccaccgaauggcuauuuucgguucgauaguugggugaaccaauucuacacucuggcaccuauggggaacggaaccggucgacgcagauga

SEQ ID NO: 21244 - RNA, 1617 nt, Artificial Sequence
  derived and/or modified sequence opt3 from VP1__Norovirus_and/or_Norovirus-like__KR904222
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacugugauccgacggaggaaauccccgcuccucuggguacuccagacuucguugggaagauucagggaaugcuuacacagaccacucgcacagacggcucaacccgaggccacaaggccacgguguauaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacacacaauguucaucucgccccggcuguggcgccuaccuuuccaggagaacagcuguuauucuuucguagcacuaugcccggcugcucggguuacccuaacauggaccuggauugucuccuuccccaggaguggguacaauauuucuaccaggaggcagccccagcucagucugacgucgcccuguugcgcuuugugaauccugauacggggagaguucuauucgaaugcaagcugcacaaauccggcuaugugacagucgcacauaccggacagcacgaccucgugauucccccaaacggcuacuuuagguucgauucauggguaaaccaauucuauacucuggccccgauggggaauggaaccggucggcgacgcuga

SEQ ID NO: 21245 - RNA, 1617 nt, Artificial Sequence
  derived and/or modified sequence opt3 from VP1__Norovirus_and/or_Norovirus-like__KP244320
augaagauggccagcuccgacgcuaaccccucugauggcucaaccgcaaaucuggugccugaggucaacaaugaaguuauggcccucgagccagugguaggggcgaguaucgcugccccgguggcaggacagcaaaacgucauugaccccuggauaagaaauaacuucgugcaggccccugguggcgaauuuacaguuagcccaaggaaugcucccggggagauccuuugguccgcaccucugggaccagauuugaaccccuacuuaccucaccuggcccggauguauaauggcuacgcugguggguucgaagugcaggucauucuagccggaaacgcguuuacugcaggcaaaaucauuuucgccgcugugccaccgaauuuucccacggagggccucucuccuucgcagguaaccauguucccacauaucauaguugacgugcgccaacuggagcccguccuuaucccucugccagaugugcgaaacaauuuuuaucacuacuaucagucaaacgaccccacaauuaaguugaucgccaugcucuacacuccgcugcgugcaaauaacgcuggggaugacguguucaccgucagcugcagaguucugacaaggccuagucccgauuuugacuucauuuuucucgugccaccuaccguagaaucccggacuaaacccuucucugugccagucuuaacaguggaggaaaugaccaacagccgcuuucccaucccucuggagaaacuuuucacgggaccauccucagccuucguugugcagccgcagaaugguagauguacuaccgauggcgucuugcuggggacaacucaacuaagucccgugaacauaugcaccuuuaggggagacguaacacauauuagcggcucucggaauuauaccaugaaccucgcgucccagaauuggaacucauacgauccuacggaggaaaucccagcaccccuggguacuccugacuucguugggaagauucagggagugcuuacacagaccacucgcacaaauggcagcacccgaggccacaaggccacggucuacaccgggagugcugacuuuucuccaaagcugggaagagugcaauucgccacagauacugacaacgauuuugagaccaaucagaacacaaaauucacucccgucggugugauccaggacggcuccaccacaccgaggaaugaaagccaacaguggguuuugccuucguauucugggcggaacacccauaaugugcaccucgcuccagccguagcacccacuuuuccuggagagcagcuguuauucuuucguuccacgaugcccggcuguucagguuacccaaacauggaucuggacugccuccuuccucaggaauggguccaauauuucuaccaggaggccgcucccgcgcagagugauguggcacuguugcgcuuuguuaauccagacacagggagagugcuauucgaguguaagcugcacaaaagcggcuaugucaccguggcccauacuggacagcacgaucucguaaucccgccuaacggcuacuuuagguucgacuccugggugaaccaauucuauacccuggcucccauggggaauggaacaggucggcgacgcuga

SEQ ID NO: 21246 - RNA, 1617 nt, Artificial Sequence
  derived and/or modified sequence opt3 from VP1__Norovirus_and/or_Norovirus-like__KP244315
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgugguccaggugauucuagcgggaaaugcauuuacugccggcaaaaucauuuucgcugccguaccuccaaacuuuccgacggaaggccucucgcccucacagguuaccauguucccucauaucauaguggacgcacgccaacuggagccaguccuuaucccccugccugaugugcgaaauaacuuuuaucacuacaaucagagcaacgacccaacaauuaaguugaucgcuaugcucuauacuccccugcgugccaauaacgcgggggaugacguguucaccgucaguugcagaguucugacaaggccguccccugauuuugacuucauuuuucucgugcccccaaccguagagucucggacuaaaccuuucagcgugcccgucuuaacaguggaagagaugaccaacucccgcuuuccaaucccccuggaaaaacuuuucacgggaccuucaagugccuucguugugcagccacagaaugguagauguacuaccgauggcgucuugcuggggacaacucaacuaagcccggugaacauaugcaccuuuaggggagacguaacacauauuucuggcucccggaauuacaccaugaaccucgcaucacagaauuggaacagcuaugaucccacggaggagaucccugcuccacuggguacucccgacuucguugggaagauucagggagugcuuacacagaccacuaagacagacggcaguacccgcggccacaaggccacggucuacaccgggucugcugauuuuuccccuaaacugggacgagugcaauucgccacagacacugauaaugacuuugaaaccaaccagaauacaaaguucacuccagucggugugauccaggauggcagcaccacacccagaaacgagccgcaacaguggguuuugccuucguacucugggaggaauacccauaacgugcaccucgcaccagccguagcucccacuuuuccuggagaacagcuguuauucuuucgguccacgaugcccggcuguucagguuauccaaauauggaccuggauugccuccuuccucaggaguggguccaauacuucuaucaggaagcggcacccgcccagagugacguggcucuguugcguuuuguuaacccagauacagggcgcgugcuauucgaguguaaacugcacaagagcggcuacgucaccguggcccauacuggacagcacgaccucguaaucccgccuaauggcuauuuuagauucgauuccugggugaaccaauucuacacccuggcacccauggggaacggaacagguaggcggcgauga

SEQ ID NO: 21247 - RNA, 1617 nt, Artificial Sequence
  derived and/or modified sequence opt3 from VP1__Norovirus_and/or_Norovirus-like__KP244314
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacguggguggguucgaaguccaggugauucuagccggaaacgcguuuacugcaggcaaaaucauuuucgccgcuguaccuccaaauuuuccgacggagggccucucucccucgcagguuaccauguucccucauaucauaguggacguccgccaacuggagccagugcuuaucccccugccugaugugcgaaacaauuuucaccauuauaaccagucaaaugacccaacaauuaaguugaucgccaugcucuacacuccccugcgugcaaacaacgcuggggaugacgucuucaccguuagcugcagagugcugacaaggccgaguccugauuuugacuucauuuuucucguacccccaaccguggaaucccggacuaaaccuuucucuguccccguguuaacaguugaggaaaugaccaauagccgcuuuccaaucccccuggagaaacuuuucacgggaccuuccucagccuucgugguccagccacagaacgguagauguacuaccgauggcguguugcuggggacaacucaacuaaguccgguaaauauaugcaccuuuaggggagacguuacacacauucccggcagccggaacuauaccaugaaucucgcgucucagaacuggaacuccuacgauccuacggaggaaaucccagcaccccuggguacuccugacuucguggggaagauucagggaguccuuacacagaccacucgcacaaauggcucaacccgaggccauaaggccacgguguauaccgggagcgcugacuuuaguccaaagcugggaagaauccaauucgccacagauacugacaaugauuuugagaccaaccagaauacaaaauucacucccgucggugugauccaggacggcucuaccacaccgaggaacgaaccucaacaguggguuuugccauccuacagcgggcggaauacccacaacgugcaccucgcucccgccguagcaccuacuuuucccggagagcagcuguuauucuuucguucgacgaugccaggcuguucugguuacccuaauauggaucuggacugccuccuuccccaggaauggguccaauauuucuaccaggaggccgcuccagcgcaguccgauguggcacuguugcgcuuuguuaacccggacacagggagagugcuauucgaguguaagcugcauaaaucaggcuaugucaccguggcccacacuggacagcaugaucucguaauuccucccaacggcuacuuuagguucgacaguugggugaaucaauucuauacccuggcuccaauggggaacggaacaggucggcgacgcuga

SEQ ID NO: 21248 - RNA, 1617 nt, Artificial Sequence
  derived and/or modified sequence opt3 from VP1__Norovirus_and/or_Norovirus-like__KM268078
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaucccacuggagaaacuuuucaccggacccucaagugccuucgucgugcagccucagaacgguagauguacgacugauggcguauugcuggggaccacacaacuaagcccaguuaauauuugcacuuuuaggggagacgugacccauaucacaggcucucggaacuacaccaugaaucucgcaucccagaacuggucaaauuaugauccgacggaggaaauacccgcuccucuggguacuccagacuucgucgggaagauucagggagugcuuacacagaccacucgcacagacggcagcacccgaggccacaaggccacggucuacaccgggagugcugauuuugcccccaagcugggaagagugcaauucgagacagacacugaucaugacuuugaagcaaaccagaauaccaaauucacaccuguuggugugauccaggauggcgggacuacccacaggaacgagccacaacaguggguauugcccucuuacuccggacggaauacaccgaacguccaccucgccccugcuguggcgccaaccuuucccggcgaacagcuguuauucuuucguagcacuaugccugguuguucgggguaucccaauauggaccuggauugccuccuuccacaggaguggguucaauacuucuaucaggaggcagccccugcucagucugacguggcccuguugcgcuuugucaaccccgauacgggcagagugcuauucgaauguaagcugcauaaauccggauacguaacaguggcacacaccggccagcaugaccucguuauuccaccgaauggguauuuuagguucgauucaugggucaaccaauucuacacucuggccccuaugggaaacgguaccggccggcgacgcuga

SEQ ID NO: 21249 - RNA, 1617 nt, Artificial Sequence
  derived and/or modified sequence opt3 from VP1__Norovirus_and/or_Norovirus-like__KM198555
augaagauggccagcuccgacgcuaaccccucugauggcucaaccgcaagucuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucgugcuagcgggaaaugcauuuacugccggcaaaauuaucuucgcugccguaccuccaaacuuuccgacggagggccucucgcccucacagguuaccauguucccucauauuaucguggacguccgccaacuggagccagugcuuauaccccugccugaugugcgaaauaacuuuuaucacuacaaucagagcaacgacccaacaaucaaguugauugcaaugcucuauacuccccugcgugcuaauaacgccggggaugacgucuucaccguuaguugcagagugcugacaaggccguccccugauuuugacuucaucuuucucguacccccaaccguggaaucucggacuaaaccuuucagcguccccguguuaacaguugaggaaaugaccaacucccgcuuuccaauuccccuggagaaacuuuucacgggaccuucaagugcguucgugguccagccacagaaugguagauguacuaccgauggcguguugcuggggacaacucaacuaagcccgguaaacaucugcaccuuuaggggagacguuacacauauaucuggcucccggaauuacaccaugaaccucgccucacagagcuggaauaguuaugaucccacggaggaaauuccugcaccacuggguucucccgacuucguggggaagauccagggaguccuuacucagacaacccgcacuaacggcuccacacgaggccacaaggcuaccguguacacggggagcgccgacuuuucgccuaagcugggaagaguccaauucgcuaccgauacagacaaugauuuugagacuaaccagaauaccaaauucacaccaguggguguuauucaggacggcucuacuacccccaggaacgaaccgcaacaguggguguugccuuccuacucagggcggaauauccauaacguacaccucgccccagcagucgcccccacauuuccuggagagcagcuguuauucuuucguaguaccaugcccggcuguagcgguuauccaaauauggaucuggacugccuccuuccucaggaaugggugcaauacuucuaucaggaggcugcgcccgcacaguccgauguugcccuguugcgcuuugugaacccagacacugggagaguccuauucgaguguaagcugcacaaaucuggcuacgugacgguagcucauacaggacagcacgaucucgugaucccgccuaauggcuauuuuagguucgacagcuggguuaaccaauucuacacccuggcccccauggggaacggaacuggucggcgacgcuga

SEQ ID NO: 21250 - RNA, 1617 nt, Artificial Sequence
  derived and/or modified sequence opt3 from VP1__Norovirus_and/or_Norovirus-like__KF060115
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaccuggcuacgucacaguggcucauaccggacagcacgaucucguaauucccccaaacggcuauuuuagguucgacucaugggugaaucaauucuacacucuggcccccauggggaacggaaccggucggcgacgcuga

SEQ ID NO: 21251 - RNA, 1617 nt, Artificial Sequence
  derived and/or modified sequence opt3 from VP1__Norovirus_and/or_Norovirus-like__KF060018
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacggggccuucaagugcguucguugugcagccacagaacggaagauguacuaccgauggugucuugcugggcacaacucaacuaagcccggugaauauaugcaccuuuaggggagacguaacacauauuucugggucccggaacuacaccaugaaucucgccucacagaacuggaauagcuaugaucccacggaggaaaucccugcaccacugggcacucccgacuucguugguaagauucagggggugcuuacacagaccacucgcacagacggaaguacccgaggccacaaggcuacggucuacaccggcucugccgauuuuuccccuaagcuggggagagugcaauucgcuacagacacugauaacgacuuugucaccaaucagaacacaaaauucacuccagugggaguuauccaggaugguagcaccacacccaggaaugagccgcaacaguggguguugccuucguacucuggccggaacacccauaauguacaccucgccccagcagucgcccccacuuuuccuggggaacagcuguuauucuuucguuccacgaugcccggauguucaggcuauccaaacauggaccuggauugccuccuuccucaggagugggugcaauacuucuaucaggaagcugcgcccgcacagagugacguugcccuguugcgcuuugugaauccagauacagguagaguccuauucgaguguaagcugcacaaaagcggguacgugaccguagcucauacuggccagcacgaccucgugaucccgccuaacggauauuuuagguucgauuccuggguuaaccaauucuacacccuggcccccaugggcaaugggacaggacggcgacgcuga

SEQ ID NO: 21252 - RNA, 1617 nt, Artificial Sequence
  derived and/or modified sequence opt3 from VP1__Norovirus_and/or_Norovirus-like__KC517365
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggauacaacucaacuaucaccagucaacauuugcaccuuuaggggagacgugacacauaucgcagggagucggaauuacaccaugaaccucgcuagccugaauuggaacaauuaugauccgacggaagagauucccgccccucuuggcacuccagacuucguagguaagauccaggggaugcugacacagaccacuaagggagacggcucuacacgcggccacaaggcuaccguuuacacgggguccgcccccuuuaccccuaaauugggaucagugcaguucgaaacagauacugagaacgacuuugaaacccaucaaaauacaaaguucacuccagucggugugauccaggauggcgggaccacacaccgaaacgagccccagcaauggguccucccgagcuacaguggaagaaaugugccuaacgcacaccuggccccagcuguugcgcccaccuuuccuggcgagcaguuacuguucuuuaggucuacuaugcccgguuguuccggguauccaaauauggaccucgauugccuucugccucaggaaugggugcagcauuucuaccaagaggcagcccccgcucagagcgacguagccuugcuacgguuugucaacccagauacgggccgugugcuguucgaauguaaacuccacaagucgggauauguuacagcagcccauaccggccagcacgaccuggugauuccgccuaacggguacuuucgcuucgauucuugggucaaucaguucuauacucuugcucccaugggaaacgguaccggcagaaggcgguga

SEQ ID NO: 21253 - RNA, 1617 nt, Artificial Sequence
  derived and/or modified sequence opt3 from VP1__Norovirus_and/or_Norovirus-like__KC517360
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaaugcugacacagaccgcuaagggcgacggcuccacucgcgggcacaaggccacaguuuacaccggaucagcacccuuuacgccuaaauuggguagcgugcaguucgaaaccgacacagagaaugauuuugaaacucaucaaaacaccaaguucacaccagucggcgugauccaggacgggggaacuacccaccgaaaugagccccagcaauggguccucccgaguuacucuggcagaaacgugccuaauguucaccuggccccagcuguggcgcccacauuuccuggugagcaguuacuguucuuuagguccaccaugcccggguguagcggcugcccagauauggaccucgauugucuucugccucaggaauggguacagcauuucuaucaagaggcagcccccgcucagucggacgucgccuugcuacgguuugugaacccagauacuggacguguucuguucgaaugcaaacuccacaagucuggcuacgugacggucgcacauacagggcagcacgaccugauuauaccgccuaauggauauuuucgcuucgauuccugggugaaccaguucuacacccuugcccccauggguaacggcacugggagaaggcgguga

SEQ ID NO: 21254 - RNA, 1617 nt, Artificial Sequence
  derived and/or modified sequence opt3 from VP1__Norovirus_and/or_Norovirus-like__JX846928
augaagauggccagcuccgacgcuucucccucagauggcaguaccgcaaaccuggugccugaggucaauaacgaaguuauggcccucgagccaguggcgggggcugccaucgcagccccgguagcuggacagcaaaaugugauugaccccuggauaagaaacaauuucguccaggcaccugguggcgaauuuacagugagcccaaggaacgcccccggggagauccuuugguccgcuccucugggaccagauuugaaucccuacuuaucucaccuggcccggauguauaacggcuacgcggguggguucgaaguucaggugauucuagcaggaaaugccuuuacugcuggcaaaaucauuuucgccgcagucccuccaaacuuuccgacggagggccucucgcccucacaggugaccauguucccucauaucauaguagacguucgccaacuggagccagugcuuaucccccugccugauguccgaaauaacuuuuaucacuacaaucaguugaacgacccaacaauuaagcucaucgcuaugcuguauacuccccugcgugccaauaacgcgggggaugacguguucaccgugagcugcagaguccucacaaggccgaguccugauuuugacuucaucuuuuuaguucccccaaccguggaaucccggacuaaaccuuucucuguacccgugcugacagucgaggaaaugaccaacagccgcuuuccaauuccccuugagaaguuguucacgggaccuuccucagccuucgugguucagccacagaaugguagauguacuaccgauggcgugcugcuagggacaacucaacucaguccggucaacauaugcaccuuuaggggagacgugacacauauuagcggcucucggaauuacaccaugaaccuggcaucccagaauuggaacucauaugaucccacggaggaaaucccugcuccacuugguacucccgacuucguagggaaaauucagggaguucugacacagaccacucgcacaaauggcagcacccgaggccacaaggccacgguguacaccgggagugcugacuuuucuccuaaguugggaagaguccaauucgccacagauacugacaacgauuuugagaccaaucagaacacaaaauucacuccagugggugucauccaggacggcaauaccacacccaggaacgaaccgcaacagugggugcucccuuccuacagcgggcggaauauccagaacguucaucuggcaccagccguggcucccaccuuuccuggagagcaguuacuguucuuucguucgacuaugcccggcuguucugguuauccaaauauggaucucgacugccuucugccucaagaauggguacaguacuucuaucaggaggcggcacccgcccaguccgaugucgcuuugcuacgcuuugugaacccagacacggggagaguucuguucgaguguaagcuccacaaaucaggcuacgugacagucgcccacaccggacaacaugaucuggugauuccgccuaacggcuauuuuagguucgacaguuggguaaaucaguucuacacucuugcacccauggggaacggaaccggucggcgacgcuga

SEQ ID NO: 21255 - RNA, 1617 nt, Artificial Sequence
  derived and/or modified sequence opt3 from VP1__Norovirus_and/or_Norovirus-like__JX459904
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggaaugcuuacacagaccacucgcacagacggcagcacccgaggccacaaggcuacgguguacaccgggagugccgauuuuucuccuaagcugggaagaguccaauucgcuacagacacugauaaugacuuugugaccaaucagaacacaaaauucacuccagucggugugauccaggauggcuccaccacacccaggaaugagccgcaacaguggguuuugccuagcuacucggggcggaacacccauaaugugcaccucgccccagcaguagcccccacuuuuccuggagaacagcuguuauucuuucguucuacgaugcccggcuguuccgguuauccaaacauggaccuggauugccuccuuccucaggaguggguccaauacuucuaucaggaagcugcgcccgcacagucagacguggcccuguugcgcuuuguuaauccagauacagggagagugcuauucgaguguaagcugcacaaaaccggcuacgucacuguggcucauaccggacagcacgaccucguaaucccgccuaacggcuauuuuagguucgauaguugggugaaccaauucuacacacuggcccccauggggaauggaaccggucggcgacgcuga

SEQ ID NO: 21256 - RNA, 1617 nt, Artificial Sequence
  derived and/or modified sequence opt3 from VP1__Norovirus_and/or_Norovirus-like__JX459649
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuucaaucccacuggagaaacuuuucacgggacccaguagcgcguucguugugcagccucagaaugguagauguacuaccgauggcgucuugcuggggacaacucaacuaucuccagugaacauaugcaccuuuaggggagacguaacacauauuccgggcucccggaauuacaccaugaaccucgccucacagaauuggaacagcuaugaucccacggaggaaaucccugcaccacuggguacucccgacuucguugggaagauucagggagugcuuacacagaccacucgcacaaauggcaguacccgaggccacaaggcuacggucuacaccgggucugccgacuuuuccccuaagcugggaagagugcaauucgcuacagauacugacaacgauuuugagaccaaucagaacacaaaauucacuccagucggugugauccaggacggcagcaccacacccaggaaugaaccgcaacaguggguuuugccuucguacucugggcggaacauccauaaugugcaccucgccccagcaguagcccccaccuuuccuggagagcagcuguuauucuuucguuccacuaugcccggcuguucagguuauccaaacauggaucuggacugccuccuuccucaggaauggguccaauacuucuaucaggaggcugcgcccgcacagagugauguggcccuguugcgcuuuguuaauccagacacggggagagugcuauucgaguguaagcugcacaaaagcggcuacgucacaguggcucauaccggacagcacgaucucguaauuccgccuaacggcuauuuuagguucgacuccugggugaaccaauucuacacucuggcccccauggggaauggaaccggucggcgacgcuga

SEQ ID NO: 21257 - RNA, 1617 nt, Artificial Sequence
  derived and/or modified sequence opt3 from VP1__Norovirus_and/or_Norovirus-like__JX459643
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagaguggaguucgcuacagauacugacaaugauuuugaaaccaaccaaaauacaaaauucacucccgucggugugauccaggacggcucuaccacaccgaggaacgagccucagcaauggguuuugccauccuacagcgggcggaauauccauaacgugcaccucgcccccgcaguagccccuaccuuucccggagaacagcuguuauucuuucguucgacuaugccaggcuguucugguuauccuaauauggaucuggacugccuccuuccccaggaguggguccaguacuucuaucaagaggcugcgccagcacaguccgauguggcccuguugcgcuuuguuaacccggacacggggagagugcuauucgaauguaagcugcacaaaucaggcuacgucacaguggcucauaccggacagcacgaucucguaauuccucccaacggcuauuuuagguucgacaguugggugaaucaguucuacacucuggccccaauggggaacggaaccggucggcgacgcuga

SEQ ID NO: 21258 - RNA, 1617 nt, Artificial Sequence
  derived and/or modified sequence opt3 from VP1__Norovirus_and/or_Norovirus-like__JX459602
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccagucucgacuuugauuucaucuuuuuagugccgccuacaguagagucccggaccaaacccuucacugugccaauccugacagucgaagagaugaccaacucucgcuuuccuauaccccuugagaaguuguucacgggaccaagcggugccuucgugguucagccccagaauggcagauguacuaccgacggggugcugcuaggaacaacucaacucuccccugucaacauuugcaccuuuaggggcgaugugacacauaucgcagguucacggaauuacaccaugaaccuggcuagucuuaauuggaacaauuaugacccaacggaagagacuccggcuccccuggggacaccugauuucguaggaaaaauucagggcguuuugacccagacuacaaagggcgacgggagcacccgcggacacaaggccacgguguacaccgguucugccccauuuacacccaaacucggcuccguccaguucucaacugacaccgaaaacgauuuugagacacaucaaaauacuaaguucaccccugugggggucauccaggacggaggcacaacccaccgaaacgaaccacagcaaugggugcugcccagcuacagugguagaaauguucacaacgugcauuuagcaccggccguagcuccuacuuuuccaggggagcagcuccucuucuuuaggucuacgaugcccggcuguuccggauauccuaauauggaucuugacugccuguugccccaggaguggguccagcacuucuaccaagaagcggcaccagcccagagcgauguggcucuacugcgguuuguuaacccugacacaggccgugugcuguucgaguguaaacugcauaagucgggguaugucaccguggcccacacuggacagcacgaucuuguaauucccccaaacgguuacuuucgcuucgacucuugggugaaucaguucuauacccuggcaccgaugggcaacgggacaggaagaaggcgguga

SEQ ID NO: 21259 - RNA, 1617 nt, Artificial Sequence
  derived and/or modified sequence opt3 from VP1__Norovirus_and/or_Norovirus-like__LC177655
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggcgggcuccucugggaccagauuugaaccccuacuuaagccaccuggcccgcauguauaauggcuacgcggguggguucgaagugcaggucauucuagcaggaaacgccuuuacagcuggcaaagugaucuucgccgcaguaccuccaaauuuuccgacugagggccucucccccucucagguuacgauguucccucauauuguggucgacgugcgacaacuggagccagugcuuaucccccugccugauguccguaacaauuuuuaucacuacaaccagucgaaugacccaaccauaaaguugaucgcuaugcucuauacaccccugagagccaacaacgcgggggaugacguuuucacugugucaugcaggguacugacccggccgagcccugauuuugacuucauuuuucucgugcccccaacagucgaaagucgcaccaaaccuuucuccgugcccguuuuaacuguggaggaaaugacaaauucuagauuuccaaucccccuggagaaacuuuucaccggaccuagcuccgccuucgucgugcagccacagaacgguagguguacgacugauggcguauugcuggggaccccgcaacuaucacccguuaauauuugcacauuucggggagacgugacucauaucaccggcagucgcaacuacacaaugaaucucgcaagccagaacuggucuaauuaugauccuaccgaggaaauaccagcuccccuggguacgccugacuucgucgggaagauucagggagugcuuacucagacaacccgaacugacggcuccacaagaggccacaaggccaccgucuacacggggucagcugauuuugccccaaagcugggaagggugcaauucgagaccgacacagaucgggacuuugaagcaaaccagaauacuaaauucacccccguuggugugauccaggauggcagcacaacucaucguaacgagccgcaacaguggguauugccuaguuacucugggcgcaauaccccaaacguccaccucgcccccgcuguggcgccuacauuucccggagaacagcuguuauucuuuagauccaccaugccaggcuguagcgguuauccuaauauggaccuggauugccuccuuccccaggaguggguucaauacuucuaucaggaggcagccccagcucagucggacguggcccuguugagguuugucaacccggauacugggcgggugcuauucgaauguaagcugcacaaaucuggcuacguaacgguggcacauacaggacagcacgaccucguuauuccucccaauggcuauuuucgauucgauuccugggucaaccaauucuacacccuggccccaauggggaacggaacuggucgcagaagguga

SEQ ID NO: 21260 - RNA, 1617 nt, Artificial Sequence
  derived and/or modified sequence opt3 from VP1__Norovirus_and/or_Norovirus-like__KP784698
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcucccggaacuacaccaugaaucucgccucacagaacuggaauagcuaugauccgacggaggaaauccccgcaccucuggguacuccagacuucguugggaagauucagggagugcuuacacagaccacucgcacagacggcaguacccgaggccacaaggcuacggucuacaccgggucugccgauuuuacacccaagcugggaagagugcaauucgcuacugacaccgauaacgacuuugucacaaaucagaacacuaaauucaccccuguggguguuauccaggauggcuccacaaccccaaggaaugagccccaacaguggguguugccgagcuacucggggcggaacacucauaauguacaccucgccccugcagucgccccaacguuucccggagaacagcuguuauucuuucguucuacaaugccuggcuguuccgguuaucccaacauggaccuggauugccuccuuccacaggagugggugcaauacuucuaucaggaagcugcgccugcacagucagacguugcccuguugcgcuuugugaaucccgauaccgggagaguccuauucgaguguaagcugcacaaaaguggcuacgugacuguagcucauaccggacagcacgaccucgugaucccaccgaacggcuauuuuagguucgauagcuggguuaaccaauucuacacacuggccccuauggggaauggaaccggucggcgacgcuga

SEQ ID NO: 21261 - RNA, 1617 nt, Artificial Sequence
  derived and/or modified sequence opt3 from VP1__Norovirus_and/or_Norovirus-like__KX354104
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaucgggagcgcugauuuugccccuaagcugggaagagugcaauucgagaccgacacagaucaugacuuugaagcaaaccagaauacuaaauucaccccaguuggugugauucaggauggcgggacaacucacaggaacgagccccaacaguggguauugccgaguuacucuggacggaauaccccuaacguccaccucgccccagcuguggcgcccacauuuccuggcgaacagcuguuauucuuucguuccaccaugcccgguuguagcggguauccaaauauggaccuggauugccuccuuccucaggaguggguucaauacuucuaucaggaggcagcccccgcucagucggacguggcccuguugcgcuuugucaacccagauacuggcagagugcuauucgaauguaagcugcauaaaucuggauacguaacgguggcacacacaggccagcaugaccucguuaucccgccuaauggguauuuuagguucgauuccugggucaaccaauucuacacccuggcccccaugggaaacgguacuggccggcgacgcuga

SEQ ID NO: 21262 - RNA, 1617 nt, Artificial Sequence
  derived and/or modified sequence opt3 from VP1__Norovirus_and/or_Norovirus-like__KR904211
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgcuauugaccccuggauaagaaauaacuucguccaggcaccugguggcgaauuuacagugaguccaaggaaugcccccggggagauccuuuggagcgcuccucugggaccagauuugaaccccuacuuaucccaccuggcccggauguauaauggcuacgcggguggguucgaaguucaggugauucuagcaggaaacgccuuuacugcuggcaaaaucauuuucgccgcagucccuccaaauuuuccgacggagggccucucucccucacaggugaccauguucccucauaucauaguagacguucgccaacuggagccagugcuuaucccccugccugauguccgaaacaauuuuuaucacuacaaccagucgaaugacagcacaauuaaguugaucgcuaugcucuauacuccacugcgugccaacaacgcgggggaugacguguucaccgugaguugcagaguccugacaaggcccuccccggauuuugacuucauuuuucucguuccucccaccguggaaucucggacuaaaccauucagcguaccuaucuuaacaguggaggaaaugaccaauucccgcuuucccauaccacuggagaaacuuuucacgggacccucaagugccuucgucgugcagccucagaacgguagauguacuaccgauggcguuuugcuggggacaacucaacuaagcccagugaauauuugcaccuuuaggggagacgucacacauaucgcaggcucucggaacuacaccaugaaucucgcuucccagaacuggaacucauaugauccgacggaggaaauucccgccccucuggguacuccagacuucguggggaagauccagggaguacuuacacagaccacucgcacagacggcagcacccgaggccacaaggcuacgguuuacaccgggagugccgauuuuucucccaagcugggaagagugcaauucgcaacagacacugauaaugacuuugaugccaaucagaacaccaaauucacaccugucggugugauccaggacggcgggacuacccauaggaaugagccacaacagugggucuugcccuccuacagcggacggaacauucacaaugugcaccucgcuccggcgguugcaccuacauuuccaggcgaacagcuguuauucuuucguucgaccaugcccgguuguucuggguauccuaacauggaucuggacugccuccuuccccaggagugggugcaauacuucuaucaggaagccgcuccagcccaguccgauguagcacuguugcgcuuugucaauccugacacuggcagagugcuauucgaguguaagcugcauaaaucaggauacguuacgguggcccacacaggccagcaugaucucgucauacccccaaacggguauuuuagguucgacaguugggugaaccaauucuacacccuggcuccgaugggaaaugguacuggccggcgacgcuga

SEQ ID NO: 21263 - RNA, 1617 nt, Artificial Sequence
  derived and/or modified sequence opt3 from VP1__Norovirus_and/or_Norovirus-like__AB933743
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcucccggaacuacaccaugaaucucgccucacagaacuggaauagcuaugauccgacggaggaaauccccgcaccucuggguacuccagacuucguugggaagauucagggagugcuuacacagaccacucgcacaaacggcaguacccgaggccacaaggcuacggucuacaccgggucugccgacuuuucccccaagcugggaagagugcaauucgcuacagauacugacaaugauuuugagaccaaccagaauacaaaauucacuccugucggugugauccaggacggcagcaccacaccaaggaacgaaccccaacaguggguuuugccgucguacucugggcgguccauccauaaugugcaccucgccccugcaguagccccaaccuuucccggagagcagcuguuauucuuucguucaacuaugccuggcuguagugguuaucccaacauggaucuggacugccuccuuccacaggaauggguccaauacuucuaucaggaggcugcgccugcacagagcgauguggcccuguugcgcuuuguuaaucccgacacggggagagugcuauucgaguguaagcugcacaaauccggcuacgucacaguggcucauaccggacagcacgaucucguaauuccaccgaacggcuauuuuagguucgacucuugggugaaccaauucuacacucuggccccuauggggaauggaaccggucggcgacgcuga

SEQ ID NO: 21264 - RNA, 1617 nt, Artificial Sequence
  derived and/or modified sequence opt3 from VP1__Norovirus_and/or_Norovirus-like__LN854572
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaauucauauccccggcagccggaacuacacaaugaaucucgccucucagaacuggaacuccuaugauccuaccgaggaaauuccagcaccccuggguacgccugacuucguugggaagauccagggagugcuuacucagacaacccgcacuaauggcucaacacgaggccacaaggcuaccgucuacacggggagcgccgacuuuaguccaaagcugggaagagugcaauucgcuaccgauacagacaaugauuuugagacuaaccagaauaccaaauucacacccgucggugugauccaggacggcucuacuaccccgaggaacgaaccucaacaguggguuuugccauccuacagcgggcggaauauucauaacgugcaccucgcccccgcaguagccccuacauuucccggagagcagcuguuauucuuucguucgaccaugccaggcuguucugguuauccuaauauggaucuggacugccuccuuccccaggaauggguccaauacuucuaucaggaggcugcgccagcacaguccgauguggcccuguugcgcuuuguuaacccggacacugggagagugcuauucgaguguaagcugcacaaaucaggcuacgucacgguggcucauacaggacagcacgaucucguaauaccucccaacggcuauuuuagguucgacaguugggugaaucaauucuacacccuggccccaauggggaacggaacuggucggcgacgcuga

SEQ ID NO: 21265 - RNA, 1617 nt, Artificial Sequence
  derived and/or modified sequence opt3 from VP1__Norovirus_and/or_Norovirus-like__KP244319
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccagucucaaucccccuuccugaugugcgaaacaauuuuuaucacuacaaccagagcaaugacccaacaauuaagcugaucgcaauguuguauacuccccuccgugcuaacaacgccggggaugacguguucaccgucaguugcagaguucugacaaggccguccccugauuuugacuucauuuuucuggugcccccaaccguagaaucucggacuaaaccuuucagcgugcccguccucacaguggaggaaaugaccaauucccgcuuuccaauccccuuagagaagcuguucacgggaccuucaagugcguucguugugcagccacagaacgguagauguacuaccgauggcguccuuuuggggacaacucaacugagcccggugaauauaugcaccuuuaggggagacguaacacauauucccggcucucggaacuacaccaugaaucuagccucccagaacuggaacucauaugauccuacggaggaaaucccagcaccccucgguacuccugacuucguugggaaaauucagggagugcugacacagaccacucgcgcuaauggcagcacacgaggccacaaggccaccgucuacacggggagugcugacuuuucuccaaaacuuggaagagugcaauucgccaccgauacagacaaugauuuugagacuaaccagaauaccaaguucacacccgucggugugauccaggacggcuccacuaccccgaggaacgaaccucaacaguggguucugccaagcuacucggggcggaauauccauaacgugcacuuggcacccgccguagcuccuacauuucccggagagcagcuccuguucuuucguucuaccaugccaggcuguuccgguuauccuaauauggauuuagacugccugcucccccaggaauggguccaauacuucuaucaggaggcggcaccagcccagucagauguggcccuucugcgcuuuguuaacccggacacugggagaguguuguucgaguguaagcuacacaaaaguggcuacgucacgguggcucauacaggacagcacgaucugguaauuccucccaacggcuauuuuagguucgacagcugggugaaucaauucuacacccucgcaccaauggggaacggaacuggucggcgacgcuga

SEQ ID NO: 21266 - RNA, 1617 nt, Artificial Sequence
  derived and/or modified sequence opt3 from VP1__Norovirus_and/or_Norovirus-like__KF768470
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugucuauaugcaccuuuaggggagacguaacacauauuccgggcucccacaauuacaccaugaaccucgccucacagaauuggaacagcuaugaucccacggaggaaaucccugcaccacuggguacucccgacuucguugggaagauucagggagugcuuacacagaccacucggacaaauggcaguacccgcggccauaaggcuacggucuacaccgggucugccgacuuuuccccuaagcugggacgagugcaauucgcuacagauacuaacaaugacuuugagaccaaccagaauacaaaauucacuccagucggugugauccaggauggcagcaccacacccagaaacgaaccgcaacaguggguuuugccuucguacucugggaggaauauccacaacgugcaccucgccccagcaguagcccccaccuuuccuggagagcagcuguuauucuuucgguccacuaugcccggcuguucagguuauccaaauauggaccuggauugccuccuuccucaggaauggguccaauacuucuaucaggaggcugcgcccgcacagagugacguggcccuguugcguuuuguuaacccagauacggggcgcgugcuauucgaguguaagcugcauaaaagcggcuacgucacaguggcucacaccggacagcaugaccucguaauuccgccuaacggcuauuuuagauucgauuccugggugaaucaauucuacacucuggcccccauggggaacggaaccgguaggcggcgauga

SEQ ID NO: 21267 - RNA, 1617 nt, Artificial Sequence
  derived and/or modified sequence opt3 from VP1__Norovirus_and/or_Norovirus-like__KC456073
augaagauggccagcuccgacgcuaaccccucugauggcucagcagccaaucuggugccuaaagucaacaaugagguuauggcgcucgaaccagugguaggggcugccaucgcagccccgguggcuggacagcaaaacgucauugaccccuggauaaagaauaacuucgugcaggcaccugguggcgaguuuaccguuaguccaaagaaugcccccggggaaauccuuuggagcgcuccucugggaccagauuugaaccccuacuuaucccaccuggccagaauguauaauggcuacgcggguggguucgaggugcaggucauucuagcaggaaacgccuuuacagcuggcaaggugaucuucgccgcaguaccuccaaauuuuccgacugaaggccucucucccucgcagguuacgauguucccucauauuguggucgacgugaggcaacuggagccagugcuuaucccccugccugauguccggaacaauuuuuaucacuacaaccagucaaaugacccaaccauaaaauugaucgcuaugcucuauacaccccugcgcgccaacaacgcgggggaugacguuuucacugugagcugccgaguacugacccguccgaguccugauuuugacuucauuuuucucgugcccccaacagucgaguccagaaccaagccuuucucugugcccguuuuaacuguggaagagaugacaaauagcagguuuccaaucccccuggaaaaacuuuucaccggaccuuccucagccuucgucgugcagccacagaacggucgguguacgacugauggcguauugcuggggaccacacaacuaaguccgguuaauauuugcacuuuucgcggagacgugacccauaucacaggcagcagaaacuacaccaugaaucucgcaucucagaacuggaauaacuaugaucccacggaggagauaccugcuccacuggguacucccgacuucgucgggaaaauucagggagugcuuacacagaccacuaggacagacggcuccacccggggccacaaggccacggucuacaccgggucagcugauuuugccccuaaacugggacgcgugcaauucgaaacagacacugaucaugacuuugaggcaaaucagaacaccaaguucacaccaguuggugugauccaggauggcgggacuacccaccgaaaugaaccccaacaguggguauugccgagcuacaguggaagaaacacacacaauguccaucucgccccugcuguggcgccaaccuuucccggcgagcagcuguuauucuuuaggucuacuaugccugguuguuccggguaucccaacauggaccuggauugccuccuuccacaggaauggguucaauacuucuaucaggaggcagccccugcucagagcgacguggcccuguugcgguuugucaaucccgauacgggccgugugcuauucgaguguaaacugcacaagucgggauacguaacaguggcacauaccggccagcacgaccucguuauuccaccgaacggguauuuucgcuucgauucuugggucaaccaauucuacacucuggccccuaugggaaaugguaccggcagaaggcgguga

SEQ ID NO: 21268 - RNA, 1617 nt, Artificial Sequence
  derived and/or modified sequence opt3 from VP1__Norovirus_and/or_Norovirus-like__KC456072
augaagauggccagcuccgacgcuaaccccucugauggcucagcagccaaucuggugccuaaagucaacaaugagguuauggcgcucgaaccagugguaggggcugccaucgcagccccgguggcuggacagcaaaacgucauugaccccuggauaaagaauaacuucgugcaggcaccugguggcgaguuuaccguuaguccaaagaaugcccccggggaaauccuuuggagcgcuccucugggaccagauuugaaccccuacuuaucccaccuggccagaauguauaauggcuacgcggguggguucgaggugcaggucauucuagcaggaaacgccuuuacagcuggcaaggugaucuucgccgcaguaccuccaaauuuuccgacugaaggccucucucccucgcagguuacgauguucccucauauuguggucgacgugaggcaacuggagccagugcuuaucccccugccugauguccggaacaauuuuuaucacuacaaccagucaaaugacccaaccauaaaauugaucgcuaugcucuauacaccccugcgcgccaacaacgcgggggaugacguuuucacugugagcugccgaguacugacccguccgaguccugauuuugacuucauuuuucucgugcccccaacagucgaguccagaaccaagccuuucucugugcccguuuuaacuguggaagagaugacaaauagcagguuuccaaucccccuggaaaaacuuuucaccggaccuuccucagccuucgucgugcagccacagaacggucgguguacgacugauggcguauugcuggggaccacacaacuaaguccgguuaauauuugcacuuuucgcggagacgugacccauaucacaggcagcagaaacuacaccaugaaucucgcaucucagaacugguccaauuaugaucccacggaggagauaccugcuccacuggguacucccgacuucgucgggaaaauucagggagugcuuacacagaccacuaggacagacggcucaacccggggccacaaggccacggucuacaccgggagcgcugauuuugccccuaaacugggacgcgugcaauucgaaacagacacugaucgagacuuugaggcaaaccagaauaccaaguucacaccaguuggugugauccaggauggcaguacuacccauagaaacgaaccccaacaguggguauugccgucuuacuccgggaggaauacaccuaacguccaccucgccccagcuguggcgcccaccuuuccuggagagcagcuguuauucuuucggagcacuaugcccggcuguucggguuauccaaauauggaccuggauugccuccuuccucaggaauggguucaauacuucuaucaggaggcagcccccgcucagucugacguggcccuguugcguuuugucaacccagauacggggcgcgugcuauucgaguguaaacugcacaaguccggcuacguaacaguggcacauaccggacagcacgaccucguuauuccgccuaauggcuauuuuagauucgauucaugggucaaccaauucuacacucuggcccccauggggaacggaaccgguaggcggcgauga

SEQ ID NO: 21269 - RNA, 1617 nt, Artificial Sequence
  derived and/or modified sequence opt3 from VP1__Norovirus_and/or_Norovirus-like__JX459622
augaagauggccagcaacgacgcucaccccuccgauggcucugcagccacccuggugccuaaagucaauaacgagguuauggcgcucgaaccagugguaggggcugccaucgcagccccgguggcuggacagcaaaaugucauugaccccuggauaagaaacaauuucgugcaggcaccugguggcgaguuuacaguuucaccaaggaacgcccccggggaaauccuuuggagugcuccucugggaccagauuugaaucccuacuuaagccaucuggcccggauguauaacggcuacgcggguggguucgagcuacacgugcuccuggcaggaaaugccuuuacugcuggcaagauuaucauugccgcagucccuccaaacuucccgacggaaggccuuucccccucucaggugaccauguuuccucauaucauaguagacguucgccagcuggagccaguguugaucccccucccugauguccgaaauaacuucuaucacuacaaucaaucgaacgacucaacaauuaaacugaucgcuaugcuguauacuccacuccgugccaauaacgcgggggaggauguguuuaccgugagcugcagagucuuaacaaggcccaguccggacuucgauuuuauuuuccugguuccucccaccguggaaucccggacuaagccauuuacaguaccuauccuuaccguggaggaaaugacgaacucucgcuuccccauaccauuggagaaacuguuuacuggacccagcggugccuucgucgugcagccucagaauggcagauguaccacagacgggguucuacucggaacuacccagcuguccccagugaacauuugcaucuucaggggcgaugucacacauauugcagguucacggaauuacaccaugaaccuugcugcccugaauuggaacaauuaugacccgacggaggaaauccccgcuccuuuggggacuccagauuuugugggaaagauccaaggcguacucacacagaccacuaagggcgacgggaguacacgcggacacaaagccaccguuuacacggguagcgcagacuucacccccaagcugggcucugugcaguuuuccacagauacugagaacgacuucgaaacccaccagaauacaaaauuuacuccugucggggugauucaagauggaucaaccacacaucgaaacgagccacagcagugggucuuacccagcuacaguggcagaaaugugcacaacguucaucuggccccggcuguggcgccuaccuucccaggugaacaacuccuguuuuucaggucuacuaugcccggguguuccggcuauccuaauauggaccuugauugcuugcuaccccaggaguggguacagcacuuuuaccaggaggcagccccagcucaaagcgacgucgcccugcuccgguucgugaacccugauacgggacguguucuguuugaauguaaacuucacaagucgggcuaugugacagucgcacauaccgggcagcacgaccuggugauacccccaaauggauacuuccgcuuugauucuuggguaaaccaguucuauacuuuggccccgauggguaacggcaccgggagaaggcgguga

SEQ ID NO: 21270 - RNA, 1617 nt, Artificial Sequence
  derived and/or modified sequence opt3 from VP1__Norovirus_and/or_Norovirus-like__KX514290
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccuaucuuaaccgucggagagaugacuaacucccgcuuucccauaaaucuggaaagacuuuucacagguccaucaagugccaacgugguucagccccagaaugggagguguaccauugauggcgaguugcugggaacgacucaacuaagcucugugaacaucugcaccuuccggggcgacgucacacauauugguuccacucaccauuggaccaugaaucucgcaucaccuaacuggaauaacuacgauccaacagaggaaaccccggcuccccuggggacgccugacuuugugggaaagauccacggcaugcuuacucagacaacccaggagaauggcagcacucgcgcccaccgagcuacaguauauguugggagugccgacuucaccccaaaacugggaaaggugcaguuugaaacggauaccacaaacgacuuggaugcacaucaaaauacuaaguucacccccgucggugugguccagggcggggagucuccuaaaggauccgaaccacagcaaugggugcuccccagcuacucgggcagagacacaccgaacguucaccuggccccugcuguggcgccaacuuuucccggugagcaguuacuguucuuuaggucuaccaucccuggguguggcggacaucccaauaugaaccucgauugccuucugccacaggaguggguacagcacuucuaccaagaagcagccccugcucaguccgacgucgccuugcuacgguuugugaaccccgauacaucacguguucuguucgaguguaagcuccacaaaaguggcuaugugaccgucgcacauacugggcagcacgaccuggugauuccaccgaauggauacuuucgcuucgauagcuggguaaaccaguuuuauacgcuugccccuauggguaauggcacagggagaaagagguga

SEQ ID NO: 21271 - RNA, 1617 nt, Artificial Sequence
  derived and/or modified sequence opt3 from VP1__Norovirus_and/or_Norovirus-like__KP784695
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcucccggaacuacaccaugaaucucgccucacagaacuggaauagcuaugauccgacggaggaaauccccgcaccucuggguacuccagacuucguugggaagauucagggagugcuuacacagaccacucgcacagacggcaguacccgaggccacaaggcuacggucuacaccgggucugccgauuuuucccccaagcugggaagagugcaauucgcuacagacacugauaacgacuuugucaccaaucagaacacaaaauucacuccuguggguguuauccaggauggcaauaccacaccaaggaacgagccccaacaguggguguugccgagcuacucggggcggaauacccauaacguacaccucgccccugcagucgccccaacuuuucccggagaacagcuguuauucuuucguucuacgaugccuggcuguuccgguuaucccaauauggaccuggauugccuccuuccacaggagugggugcaauacuucuaucaggaagcugcgccugcacagucagacguugcccuguugcgcuuugugaaccccgauacagggagaguccuauucgaguguaagcugcacaaaaguggcuacgugaccguagcucauacuggacagcacgaccucgugaucccaccgaacggcuauuuuagguucgauagcuggguuaaucaauucuacacccuggccccuauggggaacggaacaggucggcgacgcuga

SEQ ID NO: 21272 - RNA, 1617 nt, Artificial Sequence
  derived and/or modified sequence opt3 from VP1__Norovirus_and/or_Norovirus-like__KX608865
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauugccggcucucggaacuacaccaugaaucucgcaucccagaacuggaacucauaugauccgacggaggaaauccccgcuccucuggguacuccagacuucguugggaagauucagggagugcuuacacagaccacucgcacagacggcagcacccgaggccacaaggccacggucuacaccgggagugcugauuuuucucccaagcugggaagagugcaauucgccacagacacugauaaugacuuugucaccaaucagaacacaaaauucacuccuguggguguuauccaggauggcuccaccacaccaaggaaugagccccaacaguggguguugccgagcuacucggggcggaacacccauaauguacaccucgccccugcagucgcuccaacuuuucccggagaacagcuguuauucuuucguucuacgaugccuggcuguuccgguuaucccaacauggaccuggauugccuccuuccacaggagugggugcaauacuucuaucaggaagcggccccugcacagucagacguugcucuguugcgcuuugugaaucccgauacagggagaguccuauucgaguguaagcugcacaaaaguggcuacgugaccguagcccauacuggacagcacgaccucgugaucccaccgaacggcuauuuuagguucgauagcuggguuaaccaauucuacacccuggcaccuauggggaauggaacaggucggcgacgcuga

SEQ ID NO: 21273 - RNA, 1617 nt, Artificial Sequence
  derived and/or modified sequence opt3 from VP1__Norovirus_and/or_Norovirus-like__AB972500
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcucccggaacuacaccaugaaucucgccucacagaacuggaauagcuaugauccgacggaggaaauccccgcaccucuggguacuccagacuucguugggaagauucagggagugcuuacacagaccacucgcacaaacggcaguacccgaggccacaaggcuacggucuacaccgggucugccgacuuuucccccaagcugggaagagugcaauucgcuacagauacugacaaugauuuugagaccaaccagaauacaaaauucacuccugucggugugauccaggacggcagcaccacaccaaggaacgaaccccaacaguggguuuugccgucguacucugggcggaauauccauaacgugcaccucgccccugcaguagccccaaccuuucccggagagcagcuguuauucuuucguuccacuaugccuggcuguucagguuaucccaauauggaucuggacugccuccuuccacaggaauggguccaauacuucuaucaggaggcugcgccugcacagagugauguggcccuguugcgcuuuguuaaccccgacacggggagagugcuauucgaguguaagcugcacaaaagcggcuacgucacaguggcucauaccggacagcacgaucucguaauuccaccgaacggcuauuuuagguucgacuccugggugaaucaauucuacacucuggccccuauggggaacggaaccggucggcgacgcuga

SEQ ID NO: 21274 - RNA, 1617 nt, Artificial Sequence
  derived and/or modified sequence opt3 from VP1__Norovirus_and/or_Norovirus-like__KT033902
augaagauggccagcuccgacgcuaaccccucugauggcucaaccgcaaaucugaucccugaggugaacaaugaagucauggcccucgagccaguugugggggcggcuauugccgcaccgguagccggacagcaaaacgugauagaccccuggaucagaaauaacuucguccaggcuccugguggcgaauuuacagugaguccaaggaaugcacccggggagauucuuuggagcgccccucugggaccagauuugaaccccuacuuaucccaccuggcucggauguauaauggcuacgccgguggguucgaaguucaggugauccuagcgggaaacgcauuuacugccggcaaaauuaucuucgcugccgucccuccaaauuuuccgacggagggccucucucccucacaggugaccauguucccucauauaaucguagacguucgccaacuggagccagugcuuauuccccugccugauguccgaaacaauuuuuaucacuacaaccagucgaaugacagcacaaucaaguugauugcaaugcucuauacuccacugcgugcuaacaacgccggggaugacaucuucaccgugaguugcagagugcugacaaggcccuccccggauuuugacuucauauuucucgucccucccaccguugaaucucggacuaaaccauucagcgugccuguauuaacaguggaggaaaugaccaauucccgcuuucccauuccacuggagaaacuuuucacgggacccucaagugcguuggucgugcagccucagaacgguagauguacuaccgauggcguucugcuagggacaacucaacucagcccagugaauaucugcaccuucaggggagacgucacacauauuccgggcucucggaacuacaccaugaaucuggccucccagaacuggaacucauaugaucccacggaggaaaucccugcaccacuugguacucccgacuuuguggggaagauccagggaguacugacacagaccacucgcacaaauggcagcacccgaggccacaaggcuacgguuuacaccgggagugccgacuucucuccuaaguugggaagagugcaauuugcuacagauacugacaaugauuucgagaccaaccagaauacaaaauuuacuccagucggugugauucaggacggcuccaccacacccaggaacgaaccgcaacaguggguccucccuagcuacucggggcggaauauacauaacgugcaccuggccccagcaguugcccccaccuucccuggagagcaguuacuguuuuuccguucuacuaugcccggcuguuccgguuauccaaauauggaucucgacugccuucugccucaggaaugggugcaauacuuuuaucaggaggcugcgcccgcacagucagauguagccuugcuacgcuucgucaacccagacacggggagagugcuguuugaguguaagcuccacaaaaguggcuacguuacaguggcucauaccggacagcacgaucuggucaucccgccuaacggcuauuucagguuugacagcugggugaaucaauucuacacucuugcccccauggggaacggaaccggucggcgacgcuga

SEQ ID NO: 21275 - RNA, 1617 nt, Artificial Sequence
  derived and/or modified sequence opt3 from VP1__Norovirus_and/or_Norovirus-like__KR904220
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagugggaaacgcguuuacugcaggcaaaaucauuuucgccgcuguaccuccaaauuuuccgacggagggccucucucccucgcagguuaccauguucccucauaucauaguggacguccgccaacuggagccagugcuuaucccccugccugaugugcgaaacaauuuuuaucacuacaaccagucaagcgacaguacaauuaaguugaucgccaugcucuauacuccacugcgugcaaauaacgcuggggaugacgucuucaccguuuccugcagagugcugacaaggcccucuccggauuuugacuucauuuuucucguaccucccaccguggaaagccggacuaaaccauucuccgucccuguguuaacaguugaggaaaugaccaacucacgcuuucccaucccacuggagaaacuuuucacgggacccaguagcgccuucgugguccagccucagaaugguagauguacuaccgauggcguguugcuggggacaacucaacuaucuccaguaaacauaugcaccuuuaggggagacguuacacauauuuccggcucacacaauuacaccaugaaccucgcgagccagaauuggaacaguuaugauccgacggaggaaauccccgccccucuggguacuccagacuucguggggaagauucagggaguccuuacacagaccacucggacagacggcucuacccgcggccauaaggcaacgguguacaccggguccacagauuuuacucccaagcugggacgagcucaauucgccaccgacacagauaaugacuuugagacuaaccagaauaccaaauucacaccugucggugugauccaggauggcgggaccacucacagaaacgaaccacaacaguggguuuugcccagcuacucgggaaggaauacgcacaacgugcaucucgcuccggccguagcaccuacauuuccaggcgagcagcuguuauucuuucggucuaccaugcccgguuguuccggguauccuaauauggaccuggauugccuccuuccccaggaauggguccaauacuucuaucaggaggccgcuccagcgcagucagacguggcacuguugcguuuuguuaacccugauacuggccgcgugcuauucgaguguaagcugcacaaaaguggauacgucaccguggcccauacaggccagcacgaccucguaauucccccaaauggguauuuuagauucgauagcugggugaaccaauucuacacccuggcuccgaugggaaacgguacuggcaggcggcgauga

SEQ ID NO: 21276 - RNA, 1617 nt, Artificial Sequence
  derived and/or modified sequence opt3 from VP1__Norovirus_and/or_Norovirus-like__LN854566
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaucucauauuaccggcucccggaacuacacaaugaaucucgcaucacagaacuggaauaacuaugauccgaccgaggaaauccccgcuccucuggguacgccagacuucguugggaagauucagggaaugcuuacucagacaacccgcgccgacggcagcacucgaggccacaaggcuacaguguacaccgggagugccgauuuugcacccaagcugggaagaguccaauucgagacggacaccgaucaugacuuugaagccaaucagaacacaaaauucacuccugugggugucauccaggauggcucuaccacacacaggaaugagccacaacaguggguguugcccuccuacagcgggcggaacacucacaauguucaucucgcuccggcgguggcaccuaccuuuccaggagaacagcuguuauucuuucguucgacaaugcccggcuguucugguuauccuaacauggaccuggauugccuccuuccccaggaguggguacaauacuucuaucaggaggccgcuccagcccaguccgacgucgcacuguugcgcuuugugaauccugauaccgggagaguucuauucgaauguaagcugcacaaaucaggcuacgugacugucgcccauacgggacagcacgaccucgugauucccccaaacggcuauuuuagguucgauaguuggguaaaccaauucuacacacuggcuccgauggggaauggaaccggucggcgacgcuga

SEQ ID NO: 21277 - RNA, 1617 nt, Artificial Sequence
  derived and/or modified sequence opt3 from VP1__Norovirus_and/or_Norovirus-like__KP244313
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcucccggaacuacaccaugaaucucgccucacagaacuggaauagcuaugauccgacggaggaaauccccgcaccucuggguacuccagacuucguugggaagauucagggagugcuuacacaggcuacccgcacuaacggcaguacacgaggccacaaggccaccgucuacacggggucugcugacuuuucccccaagcugggaagagugcaauucgccaccgauacagacaaugauuuugagacuaaccagaauaccaaauucacaccugucggugugauccaggacggcagcacuaccccaaggaacgaaccccaacaguggguuuugccgucguacucugggcggaauauccauaacgugcaccucgccccugcaguagcuccaacauuucccggagagcagcuguuauucuuucguuccaccaugccuggcuguucagguuaucccaauauggaucuggacugccuccuuccacaggaauggguccaauacuucuaucaggaggcggccccugcacagagugauguggcucuguugcgcuuuguuaaccccgacacugggagagugcuauucgaguguaagcugcacaaaagcggcuacgucacgguggcccauacaggacagcacgaucucguaauuccaccgaacggcuauuuuagguucgacuccugggugaaucaauucuacacccuggcaccuauggggaacggaacuggucggcgacgcuga

SEQ ID NO: 21278 - RNA, 1617 nt, Artificial Sequence
  derived and/or modified sequence opt3 from VP1__Norovirus_and/or_Norovirus-like__KP096342
augaagauggccagcuccgacgcuaaccccucugauggcucagcagccaaucuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggaaugcuuacacagaccacucgcacagacggcagcacccgaggccacaaggccacgguguacaccgggagugcugauuuugccccuaagcugggaagaguccaauucgagacagacacugaucaugacuuugaagcaaaucagaacaccaaauucacaccaguggguguuauccaggauggcucuacuacccacaggaaugagccccaacaguggguguugccguccuacagcgggcggaacacaccuaauguacaccucgccccagcugucgcgcccaccuuuccuggagaacagcuguuauucuuucguucgacuaugcccggcuguucugguuauccaaacauggaccuggauugccuccuuccucaggagugggugcaauacuucuaucaggaggcagcccccgcucaguccgacguugcccuguugcgcuuugugaauccagauacggggagaguccuauucgaauguaagcugcauaaaucaggcuacgugacaguagcacacaccggacagcaugaccucgugauuccgccuaacggcuauuuuagguucgauaguuggguuaaucaauucuacacucuggcccccauggggaacggaaccggucggaagcgauga

SEQ ID NO: 21279 - RNA, 1617 nt, Artificial Sequence
  derived and/or modified sequence opt3 from VP1__Norovirus_and/or_Norovirus-like__KM514067
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggaccuggauugccuccuuccucccgaguggguucaguacuucuaucaagaggcagccccagcucagucggacguggcccuguugcgcuuugucaacccggauacgggcagagugcuauucgaauguaagcugcauaaaucuggauacguaacaguggcacacaccggccagcaugaccucguuauuccucccaauggguauuuuagguucgauuccugggucaaccaguucuacacucuggccccaaugggaaacgguaccggccggcgacgcuga

SEQ ID NO: 21280 - RNA, 1617 nt, Artificial Sequence
  derived and/or modified sequence opt3 from VP1__Norovirus_and/or_Norovirus-like__KF060049
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacauuauagaccccuggaucagaaauaacuucguccaggcuccugguggcgaauuuacagugaguccaaggaaugcacccggggagauucuuuggagcgccccucugggaccagauuugaaccccuacuuaucccaccuggcucggauguauaauggcuacgccgguggguucgaaguucaggugauccuagcgggaaacgcauuuacugccggcaaaauuaucuucgcugccgucccuccaaauuuuccgacggagggccucucucccucacaggugaccauguucccucauauaaucguagacguucgccaacuggagccagugcuuauuccccugccugauguccgaaacaauuuuuaucacuacaaccagucgaaugacagcacaaucaaguugauugcaaugcucuauacuccacugcgugcuaacaacgccggggaugacguguucaccgugaguugcagaguccugacaaggcccuccccggauuuugacuucaucuuucucguuccucccaccguggaaucucggacuaaaccauucagcguaccuguguuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucucuggcucccggaacuacaccaugaaucucgccucacagaacuggaauagcuaugauccgacggaggaaauucccgcaccucuggguacuccagacuucguagggaagauccagggaguucuuacacagaccacucgcacagacggcaguacccgaggccacaaggcuacgguguacaccgggucugccgauuuuucccccaagcugggaagaguccaauucgcuacagacacugauaacgacuuugugaccaaucagaacacaaaauucacuccugucggugugauccaggauggcagcaccacaccaaggaaugagccccaacaguggguuuugccgucguacucugggcggaacacccauaaugugcaccucgccccugcaguagccccaacuuuucccggagaacagcuguuauucuuucguuccacgaugccuggcuguucagguuaucccaacauggaccuggauugccuccuuccacaggaguggguccaauacuucuaucaggaagcugcgccugcacagagugacguggcccuguugcgcuuuguuaaucccgauacagggagagugcuauucgaguguaagcugcacaaaagcggcuacgucaccguggcucauacuggacagcacgaccucguaauuccaccgaacggcuauuuuagguucgauuccugggugaaccaauucuacacccuggccccuauggggaauggaacaggucggcgacgcuga

SEQ ID NO: 21281 - RNA, 1617 nt, Artificial Sequence
  derived and/or modified sequence opt3 from VP1__Norovirus_and/or_Norovirus-like__KF059998
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaauuccugcaccacuggguacucccgacuucguagggaagauccagggaguucuuacacagaccacuagcgcuaauggcaguacacggggccauaaggccaccguguacacggggucugcugacuuuuccccuaagcugggacgcguccaauucgccaccgauacaaauaacgacuuugagacuaaucagaacaccaaauucacaccagugggugucauccaggauggcaauacuacaccccgaaacgaaccgcaacaguggguguugccuagcuacucggggagaaauauucacaacguucaccucgcaccagccguggcucccaccuuuccuggagagcagcuguuauucuuuaggucuaccaugcccggcuguuccgguuauccaaacauggaccuggauugccuccuuccucaggaauggguacaauacuucuaucaggaggcggcacccgcccagucagacgucgcucuguugcgguuugugaauccagauacugggcguguucuauucgaguguaagcugcauaaaaguggcuacgugacggucgcccacacaggacagcaugaccucgugauaccgccuaacggcuauuuucgcuucgauagcuggguaaaucaauucuacacccuggcacccauggggaacggaacugguagaaggcgguga

SEQ ID NO: 21282 - RNA, 1617 nt, Artificial Sequence
  derived and/or modified sequence opt3 from VP1__Norovirus_and/or_Norovirus-like__JX439833
augaagauggccagcuccgacgcuaaccccucugauggcucaaaagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuaccguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacagccggcaagaucauuuucgcugccgugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaauugaucgcaaugcucuauacaccccugcgugcuaacaacgccggggaugacguguucacugucagcugcagaguucugaccaggccgaguccugauuuugacuucauuuuucucgugcccccaacaguagaaucccggaccaagccuuucucugugcccgucuuaacuguggaggaaaugacaaauagccgcuuuccaaucccccuggagaaacuuuucaccggaccuuccucagcguucguugugcagccacagaacgguagauguacgacugauggcgucuugcuggggaccacacaacuaaguccggugaauauaugcacuuuuaggggagacguaacccauauucccggcagccggaacuacacaaugaaucucgccucucagaacuggaacuccuaugauccuaccgaggaaaucccagcaccccuggguacgccugacuucguugggaagauucagggagugcuuacucagacaacccgcacuaauggcucaacacgaggccacaaggcuaccgucuacacggggagcgccgacuuuaguccaaaacugggaagagugcaauucgcuaccgauacagacaaugauuuugagacuaaccagaauaccaaguucacacccgucggugugauccaggacggcucuacuaccccgaggaacgaaccucaacaguggguuuugccauccuacagcgggcggaauauccauaacgugcaccucgcccccgcaguagccccuacauuucccggagagcagcuguuauucuuucguucgaccaugccaggcuguucugguuauccuaauauggaucuggacugccuccuuccccaggaauggguccaauacuucuaucaggaggcugcgccagcacaguccgauguggcccuguugcgcuuuguuaacccggacacugggagagugcuauucgaguguaaacugcacaagucaggcuacgucacgguggcucauacaggacagcacgaucucguaauuccucccaacggcuauuuuagguucgacaguugggugaaucaauucuacacccuggccccaauggggaacggaacugguagccggcgauga

SEQ ID NO: 21283 - RNA, 1617 nt, Artificial Sequence
  derived and/or modified sequence opt3 from VP1__Norovirus_and/or_Norovirus-like__JQ613548
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcucccggaacuacaccaugaaucucgccucacagaacuggaauagcuaugauccggcagaggaaauccccgcuccucuggguacgccagacuucguugggaagauucagggagugcuuacucagacaacccgcacuaacggcaguacacgaggccacaaggccaccgucuacacggggucugcugacuuuucccccaagcugggaagagugcaauucgccaccgauacagacaaugauuuugagacuaaccagaauaccaaauucacaccugucggugugauccaggacggcagcacuaccccaaggaacgaaccccaacaguggguuuugccgucguacucugggcggaauauccauaacgugcaccucgccccugcaguagcuccaacauuucccggagagcagcuguuauucuuucguuccaccaugccuggcuguucagguuaucccaauauggaucuggacugccuccuuccacaggaauggguccaauacuucuaucaggaggcggccccugcacagagugauguggcucuguugcgcuuuguuaaccccgacacugggagagugcuauucgaguguaagcugcacaaaagcggcuacgucacgguggcccauacaggacagcacgaucucguaauuccaccgaacggcuauuuuagguucgacuccugggugaaucaauucuacacccuggcaccuauggggaacggaacuggucggcgacgcuga

SEQ ID NO: 21284 - RNA, 1617 nt, Artificial Sequence
  derived and/or modified sequence opt3 from VP1__Norovirus_and/or_Norovirus-like__JN595867
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaacuccagcaccccuggguacaccugacuucguugggaagauccagggagugcuuacccagacuacacgcaccaauggcucaacgcgaggccacaaggcuaccgucuacacagggagcgccgacuuuaguccaaagcugggaagagugcaauucgcuacugauaccgacaaugauuuugagacaaaccagaauacuaaauucacccccgucggugugauucaggacggcucuacaaccccgaggaacgaaccucaacaguggguuuugccauccuacagcgggcggaauauccauaacgugcaccucgcccccgcaguagccccuacuuuucccggagagcagcuguuauucuuucguucgacgaugccaggcuguucugguuauccuaauauggaucuggacugccuccuuccccaggaauggguccaauacuucuaucaggaggcugcgccagcacaguccgauguggcccuguugcgcuuuguuaacccggacacagggagagugcuauucgaguguaagcugcacaaaucaggcuacgucaccguggcucauacuggacagcacgaucucguaaucccucccaacggcuauuuuagguucgacaguugggugaaucaauucuacacccuggccccaauggggaacggaacaggucggcgacgcuga

SEQ ID NO: 21285 - RNA, 1617 nt, Artificial Sequence
  derived and/or modified sequence opt3 from VP1__Norovirus_and/or_Norovirus-like__AB629944
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauacccauaacgugcaccucgccccagcaguagcccccacuuuuccuggagagcagcuguuauucuuucguucuacgaugcccggcuguuccgguuauccaaauauggaucuggacugccuccuuccucaggaauggguccaauacuucuaucaggaggcugcgcccgcacagucagauguggcccuguugcgcuuuguuaacccagacacagggagagugcuauucgaguguaagcugcacaaaaguagcuacgucaccguggcucauacuggccagcacgaucucguaaucccgccuaacggauauuuuagguucgacuccugggugaaucaauucuacacccuggcccccaugggcaacgggacaggacggcgacauuga

SEQ ID NO: 21286 - RNA, 1617 nt, Artificial Sequence
  derived and/or modified sequence opt3 from VP1__Norovirus_and/or_Norovirus-like__AB541192
augaagauggccagcuccgacgcuaaucccccugauggcucugcagccaaccuggugccagaggucaacaaugaaguuauggcgcucgagccggugguaggggcugccaucgcagcccccguggcuggacagcaaaacgucauugacccuuggauaagaaauaacuucgugcaggcaccagguggcgaauuuaccguuucacccaggaaugccccuggggagauccuuuggagugcuccacugggacccgauuugaacccuuacuuaagccaccuggcccggauguauaauggcuacgcggguggguucgaagugcaggucauucuagcaggaaacgccuuuacagcuggcaaaaucauuuucgccgcagugccaccgaauuuucccacugagggccucuccccuucucagguaacgauguucccacauaucauaguugacgugcgccaacuggagcccguccuuaucccucugccagaugugcgaaacaauuuuuaucacuacaaccagucgaaugacucaaccauuaaguugaucgcuaugcucuauacaccccugcgugccaacaacgcgggggaagauguguucacugucagcugcagaguucugaccaggccgaguccugacuuugauuucauuuuucucgugcccccaacaguagagucccggaccaaaccuuucacugugcccaucuuaacagucgaagagaugaccaauucucgcuuuccaauaccccuggagaaacuuuucacgggaccuagcggugccuucgugguucagccacagaacggcagauguacuaccgacgggguguugcugggaacaacucaacuauccccggucaauauuugcaccuuuaggggcgaugcaacacauaucgcugguucacggaguuacaccaugaaccucgccagccugaauuggaacaauuaugaccccacggaagagauuccugcuccacuugggacucccgauuucgugggaaagauccagggcaugcugacacagaccacuaagggcgacgggucuacacgcggacacaaggccaccguauacacggguuccgcaccuuuuaccccaaaauugggcucaguucaguucagcacagacacugaaaacgauuuucaaacccaucagaauacaaaguucacucccgugggggucauccaggacggaaguaccacacaccgaaacgagccgcaacagugggugcucccuucuuacuccggcagagauguccacaaugugcaucuggccccagcuguugcgcccaccuuuccuggugaacaguuacuguucuuuaggagcacuaugcccggguguucgggcuauccaaacauggaccucgauugccuucugccucaggagugggugcaacacuucuaccaggaggcagcccccgcucagucugacguagccuugcuacgguuugucaauccagauacgggacgugugcuguucgaauguaaacuccauaaguccggcuauguuacaguggcacacaccgggcagcacgaccuggucauuccgccuaacggauacuuucgcuucgauucaugggugaaucaauucuauacucuugcccccauggguaacggcaccgggagaaggcgguga

SEQ ID NO: 21287 - RNA, 1617 nt, Artificial Sequence
  derived and/or modified sequence opt3 from VP1__Norovirus_and/or_Norovirus-like__AB504314
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaagcuguucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggcgaauccagggaaugcuuacucagacaaccaaaggcgacggcucuacgagagggcacaaggcuaccguuuccacaggaucaguggauuuuacuccuaagcuggguagcguccaauucgccaccgacacagauaacgacuuugagacuggccagaauaccagguucacaccagugggggucauccaggauggaaguucugcuuugcggaacgaaccccaacagugggugcucccggacuacuccggccguaccguucauaaugugcaccuggccccugcaguagccuuaacuuuuccaggugagcagcuucucuucuuucgcagcacgaugcccggguguucgggcuacccuaacauggaucuugacugccuguugccccaggaauggguccaacacuucuaucaggaggcugcgccaucucaguccgauguggcacuacugagauuuguuaauccugacacaggaaggguccucuucgaguguaaacugcaucgggccggcuacgugaccguggcucacacugggcagcaugaucuuguaauucccccaaacggauauuuucgauucgacucaugggugaaucaauucuacacccuggccccgauggguaacggcgcagggcgcagaagguga

SEQ ID NO: 21288 - RNA, 1617 nt, Artificial Sequence
  derived and/or modified sequence opt3 from VP1__Norovirus_and/or_Norovirus-like__KX514350
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucagucuggcaauaccaagauuuacacaaugaaccucgcauccccaaauuggaacaauuaugacccgaccgaggagauccccgcuccucuggguacgccagacuucguugggaagauucagggaaugcuuacucagacaaccaagggcgaaggcucaacucgggggcaucgcgccacaguguacgucggaagcgcuaacuacgcccccaaacugggucgagugcaauuugagaccgauacgaccgacgauuuggacgcacaccagaauacaaaguucacuccugucggcgugguucagaguggggaaucuccaaaaggauccgagccccaacagugggugcucccgagcuauucgggcagagauaccccuaacguacaucuggccccagcugucgcgcccacauuuccuggugaacaguuacuguucuuuaggucuacuauccccggguguggcggacacccaaauaugaaccucgacugccuucugccucaggagugggugcaacacuucuaccaggaggcagcccccgcucaguccgauguugccuugcuacgguuugugaauccagacaccucacguguccuguucgaauguaagcuccauaaaaguggcuaugugacaguagcacacaccgggcagcaugaucuggugaucccgccuaacggauacuuucgcuucgacagcuggguuaaccaauuuuauacucuugcccccauggguaauggcacggggagaaagagguga

SEQ ID NO: 21289 - RNA, 1617 nt, Artificial Sequence
  derived and/or modified sequence opt3 from VP1__Norovirus_and/or_Norovirus-like__KX514342
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucagucuggcaauaccaagauuuacacaaugaaccucgcauccccaaauuggaacaauuaugacccgaccgaggagauccccgcuccucuggguacgccagacuucguugggaagauucagggaaugcuuacucagacaaccaagggcgaaggcucaacucgggggcaucgcgccacaguguacgucggaagcgcuaacuacgcccccaaacugggucgagugcaauuugagaccgauacgaccgacgauuuggacgcacaccagaauacaaaguucacuccugucggcgugguucagaguggggaaucuccaaaaggauccgagccccaacagugggugcucccgagcuauucgggcagagauaccccuaacguacaucuggccccagcugucgcgcccacauuuccuggugaacaguuacuguucuuuaggucuacuauccccggguguggcggacacccaaauauggaccucgauugccuucugccucaggagugggugcaacacuucuaccaggaggcagcccccgcucaguccgacguugccuugcuacgguuugugaacccagauaccucacguguccuguucgaauguaagcuccauaaaaguggcuaugugacaguagcacacaccgggcagcaugaccuggugaucccgccuaauggauacuuucgcuucgauagcuggguuaaccaauuuuauacucuugcccccauggguaacggcacggggagaaagagguga

SEQ ID NO: 21290 - RNA, 1617 nt, Artificial Sequence
  derived and/or modified sequence opt3 from VP1__Norovirus_and/or_Norovirus-like__KX514280
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaaggacucaacaauuaaauugaucgcaaugcucuauacuccacugcgugcuaacaacgccggggaugacguguucaccgucagcugcagaguucugacaaggcccaguccggauuuugacuucauuuuucucgugccucccaccguagaaucccggucuaagccauucagcgugccugucuuaacuguggaggaaaugacaaauucccgcuuucccguuacccuggauaaacuuuucacgggaccaucaaguacuaucgugguccagccccagaacgguagauguaccauagacggcguguugcuggggacaacucaacuaagcccuguaaauauuugcaccuucaggggagauguuacacauccacgggacucuaccaucuacacgaugaaccucgcguccccgaauuggaacacuuaugaccccacagaggagauuccugccccacugggcacccccgauuuuguggguaagauccaggggaugcuuacucagacaaccaagggagcaggcucaacgcgcggccaccgagcuaccgucuacguggggagcgccaauuacgcuccuaaacugggaagaguccaguucgaaacaaacaccagugacgauuuggacgcccaucaaaauacuaaguuuacaccaguggguguuauccagggcggggagucugcacacagguccgaaccccagcaaugggugcucccgagcuauucgggacgggauauuccuaacguacaccuggccccagcugucgcgcccacuuucccuggcgagcaguuacuguuuuuccguucuaccauacccgguugugggggccauccaaauauggaccucgauugccuucugccucaggaaugggugcagcacuuuuaccaagaggcagcccccgcucaguccgacguugccuugcuacgcuucgugaacccagauacaucaagaguccuguuugaguguaaacuccauaagaguggauaugugaccguagcacacacuggccagcacgaccuggugaucccgccuaauggguacuucagguuugauagcuggguuaaccaguucuauacgcuugcccccaugggaaaugguacaggccggaaacgauga

SEQ ID NO: 21291 - RNA, 1617 nt, Artificial Sequence
  derived and/or modified sequence opt3 from VP1__Norovirus_and/or_Norovirus-like__LC177654
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaauuccgccuaacggcuauuuuagguucgacagcugggugaaucaauucuacacucuggcccccauggggaacggaaccggucggcgacgcuga

SEQ ID NO: 21292 - RNA, 1617 nt, Artificial Sequence
  derived and/or modified sequence opt3 from VP1__Norovirus_and/or_Norovirus-like__KX354026
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaauuccugcaccacuggguacucccgacuucguagggaagauccagggaguucuuacacagaccacuagcacaaauggcaguacccggggccauaaggcuacgguguacaccgggucugccgacuuuuccccuaagcugggacgcguccaauucgcuacagauacuaauaacgacuuugagaccaaucagaacacaaaauucacuccagugggugucauccaggauggcagcaccacaccccgaaaugaaccgcaacaguggguguugccuucguacucugggagaaacauucacaauguucaccucgccccagcaguggcccccaccuuuccuggagagcagcuguuauucuuuagguccacuaugcccggcuguucagguuauccaaacauggaccuggauugccuccuuccucaggaauggguacaauacuucuaucaggaggcugcgcccgcacagagugacgucgcccuguugcgguuugugaacccagauacggggcguguucuauucgaguguaagcugcauaaaagcggcuacgugacagucgcucacaccggacagcaugaccucgugauaccgccuaauggcuauuuucgcuucgauuccuggguaaaccaauucuacacucuggcccccauggggaauggaaccgguagaaggcgguga

SEQ ID NO: 21293 - RNA, 1617 nt, Artificial Sequence
  derived and/or modified sequence opt3 from VP1__Norovirus_and/or_Norovirus-like__KR904218
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucgcaucauaguugacgugcgacaacuggagccaguccuuaucccccugccugaugugcguaacaauuuuuaucauuacaaccagucaaaugacccaacaauuaaguugaucgcaaugcucuauacuccccugagagcuaacaacgccggggaugacguguucaccgucagcugcaggguucugacacggccgaguccugauuuugacuucauuuuucucgugcccccaaccguagaaucccgcacuaaaccuuucucugugcccaucuuaacagucgaggaaaugaccaauagcagauuuccaauaccccuggagaaacuuuucacgggaccuuccucagcguucgugguucagccacagaacgguagguguaguacugauggcguguugcuggggaccacacaacuaagcccggucaauauuugcacuuuucggggagacgugacccacaucgccggcucucauaacuacacaaugaaucucgcaucccagaacuggucaagcuaugaucccaccgaggaaauuccugcuccacuggguacgcccgacuucguagggaagauccagggaguucuuacucagacaacccgcacugacggcaguacacgaggccacaaggccaccguguacacggggucugcugauuuuuccccuaagcugggaagaguccaauucgccaccgacacaaauaacgauuuugagagcaaucagaacacuaaauucgcaccagugggugucauccaggacggcgggaccgcccauaggaaugaaccccaacaguggguguugccgucguacucuggacggaacauucacaauguucaccucgcuccugcgguggcaccaacauuucccggcgagcagcuguuauucuuucguuccacuauaccugguuguucaggguaucccaacauggaucuggacugccuccuuccacaggaauggguacaauacuucuaucaggaggccgcuccugcccagagugaugucgcacuguugcgcuuugugaaucccgacaccggcagaguucuauucgaguguaagcugcauaaaagcggauacgugacagucgcccacaccggccagcaugaucucgugaucccaccgaacggguauuuuagguucgacuccuggguaaaccaauucuacacucuggcuccuaugggaaaugguacgggccggcgacgcuga

SEQ ID NO: 21294 - RNA, 1617 nt, Artificial Sequence
  derived and/or modified sequence opt3 from VP1__Norovirus_and/or_Norovirus-like__KJ678150
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaccccacuggagaaacuuuucacgggacccucaagugccuucgucgugcagccucagaacgguagauguacuaccgauggcguauugcuggggacaacucaacuaagcccaguuaauaucugcaccuuuaggggagacgugacacauauuaccggcucucggaacuacacgaugaaucucgcaucccagaacuggucaaauuaugauccgacugaggaaauccccgcuccucuggguacaccagacuucgucgggaagauacagggagugcuuacccagacuacacgcaccgacggcagcacgcgaggccacaaggccaccgucuacacagggagugcugauuuugcccccaagcugggaagagugcaauucgagacugacaccgaucaugacuuugaaacaaaccagaauacuaaauucaccccuguuggugugauucaggauggcucuacaacccacaggaacgagccacaacaguggguauugcccuccuacagcgggcggaauacuccgaacguccaccucgccccugcaguggcuccaacguuucccggagaacagcuguuauucuuucguucgacaaugccuggcuguucugguuaucccaauauggaccuggauugccuccuuccacaggaguggguucaauacuucuaucaggaggcggccccugcacaguccgacguggcucuguugcgcuuugucaaccccgauaccgggagagugcuauucgaauguaagcugcauaaaucaggcuacguaacuguggcccacaccggacagcaugaccucguuaucccaccgaauggcuauuuuagguucgauaguugggucaaccaauucuacacacuggcaccuauggggaacggaaccggucggcgacgcuga

SEQ ID NO: 21295 - RNA, 1617 nt, Artificial Sequence
  derived and/or modified sequence opt3 from VP1__Norovirus_and/or_Norovirus-like__KJ678148
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaccccacuggagaaacuuuucacgggacccucaagugccuucgucgugcagccucagaacgguagauguacuaccgauggcguauugcuggggacaacucaacuaagcccaguuaauaucugcaccuuuaggggagacgugacacauauuaccggcucucggaacuacacgaugaaucucgcaucccagaacuggucaaauuaugauccgacugaggaaauccccgcuccucuggguacaccagacuucgucgggaagauacagggagugcuuacccagacuacacgcaccgacggcagcacgcgaggccacaaggccaccgucuacacagggagugcugauuuugcccccaagcugggaagagugcaauucgagacugacaccgaucaugacuuugaaacaaaccagaauacuaaauucaccccuguuggugugauucaggauggcucuacaacccacaggaacgagccacaacaguggguauugcccuccuacagcgggcggaauacuccgaacguccaccucgccccugcaguggcuccaacguuucccggagaacagcuguuauucuuucguucgacaaucccuggcuguucugguuaucccaauauggaccuggauugccuccuuccacaggaguggguucaauacuucuaucaggaggcggccccugcacaguccgacguggcucuguugcgcuuugucaaccccgauaccgggagagugcuauucgaauguaagcugcauaaaucaggcuacguaacuguggcccacaccggacagcaugaccucguuauuccaccgaauggcuauuuuagguucgauaguugggucaaccaauucuacacacuggcaccuauggggaacggaaccggucggcgacgcuga

SEQ ID NO: 21296 - RNA, 1617 nt, Artificial Sequence
  derived and/or modified sequence opt3 from VP1__Norovirus_and/or_Norovirus-like__KP244316
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauuucuggcucccggaauuacaccaugaaccucgccucacagaauuggaacagcuaugaucccacggaggaaaucccugcaccacuggguacucccgacuucguugggaagacacagggagugcuuacccagacuacaaagaccaauggcaguacgcgcggccacaaggcuaccgucuacacagggucugccgacuuuuccccuaaacugggacgagugcaauucgcuacugauaccgacaacgauuuugagacaaaucagaacacuaaguucaccccagucggugugauucaggacggcagcacaacccccagagaugaaccgcaacaguggguuuugccuucguacucugggaggaauacucauaacgugcaccucgccccagcaguagcccccacguuuccuggagagcagcuguuauucuuucgguccacaaugcccggcuguucagguuauccaaauauggaccuggaucgucuccuuccucaggaauggguccaauacuucuaucaggagcccgcuccagcgcagagugacguggcacuguugcgcuuuguuaacccggauaccgggagagugcuauucgagugcaaacugcacaagagcggcuacgucacuguggcccauaccggacagcacgaccucguaaucccucccaauggcuauuuuagguucgauuccugggugaaccaauucuacacacuggcuccaauggggaacggaaccggucggcgacgcuga

SEQ ID NO: 21297 - RNA, 1617 nt, Artificial Sequence
  derived and/or modified sequence opt3 from VP1__Norovirus_and/or_Norovirus-like__KF060072
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuucuggcucccggaacuacacaaugaaucucgcaucacagaacuggaauagcuaugauccgaccgaggaaauccccgcuccucuggguacgccagacuucguugggaagauucagggagugcuuacucagacaacccgcacugacggcaguacacgaggccacaaggccaccgucuacacggggucugcugauuuuucccccaagcugggaagagugcaauucgccaccgacacagauaacgacuuuaucacuaaucagaacaccaaauucacaccugucggugugauccaggauggcagcacuaccccaaggaaugagccccaacaguggguuuugccgucguacucugggcggaacacacauaaugugcaccucgccccugcaguagcuccaaccuuucccggagaacagcuguuauucuuucguuccacuaugccuggcuguucagguuaucccaacauggaccuggauugccuccuuccacaggaguggguccaauacuucuaucaggaagcggccccugcacagagugacguggcucuguugcgcuuuguuaaucccgauacggggagagugcuauucgaguguaagcugcacaaaccaggcuacgucacaguggcccauaccggacagcacgaccucguaauuccgccuaacggcuauuuuagguucgauagcugggugaaccaauucuacacucuggcacccauggggaauggaaccggucggcgacgcuga

SEQ ID NO: 21298 - RNA, 1617 nt, Artificial Sequence
  derived and/or modified sequence opt3 from VP1__Norovirus_and/or_Norovirus-like__JX439822
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaucaggcuacgucacaguggcucauaccggacagcacgaucucguaauuccucccaacggcuauuuuagguucgacaguugggugaaucaauucuacacucuggccccaauggggaacggaaccgguagccggcgauga

SEQ ID NO: 21299 - RNA, 1617 nt, Artificial Sequence
  derived and/or modified sequence opt3 from VP1__Norovirus_and/or_Norovirus-like__KC463910
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaauuccugcaccacuggguacucccgacuucguagggaagauccagggaguucuuacacagaccacuagcacaaauggcaguacccggggccauaaggcuacgguguacaccgggucugccgacuuuuccccuaagcugggacgcguccaauucagcacagauacuaauaacgacuuugagaccaaucagaacacaaaauucacuccagugggugucauccaggauggcucgaccacaccccgaaaugaaccgcaacaguggguguugccuucuuacuccgggagaaacauucacaauguucaccucgcuccagccguggcacccaccuuuccuggagagcagcuguuauucuuuaggucaacuaugcccggcuguagugguuauccaaacauggaccuggauugccuccuuccucaggaauggguacaauacuucuaucaggaggccgcucccgcgcagagcgacgucgcacuguugcgguuugugaacccagauacggggcguguucuauucgaguguaagcugcauaaauccggcuacgugacagucgcccacaccggacagcaugaccucgugauaccgccuaauggcuauuuucgcuucgauucuuggguaaaccaauucuacacucuggcucccauggggaauggaaccgguagaaggcgguga

SEQ ID NO: 21300 - RNA, 1617 nt, Artificial Sequence
  derived and/or modified sequence opt3 from VP1__Norovirus_and/or_Norovirus-like__JX459651
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuuccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaauuccgccuaacggcuauuuuagguucgacagcugggugaaucaauucuacacucuggcccccauggggaacggaaccggucggcgacgcuga

SEQ ID NO: 21301 - RNA, 1617 nt, Artificial Sequence
  derived and/or modified sequence opt3 from VP1__Norovirus_and/or_Norovirus-like__AB541314
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaaguggucuucacuguuaguugcagagugcugaccaggcccuccccggauuuugacuucauuugucucguaccucccacaguggagucucggaccaaaccauuuacugucccuaucuuaacaguggaagagaugaccaauagccgcuuccccauaccacuggagaaacuuuuuacgggacccuccucagccuucguugugcagccucagaacgguagaugcacuaccgauggcgucuugcuggggacaacucaacuaaguccagugaauauuuguaccuucaggggagacguaacacauaucgcaggcagccggaacuacaccaugaaucucgcuucucugaacuggaauaacuaugauccgacggaagagauucccgccccucuugguacuccagacuuuguugggaagauccagggagugcugacacagaccacuaagggcgauggcuccacacgcgggcacaaggcuaccgucuacacgggaucagcccccuucaccccuaaauuggguagcgugcaguuuaguacagacacugaaaaugacuucgagacccaucaaaacacaaaguuuacuccagucggcgugauccaggaugggggaaccacacaccgaaaugaaccccagcaauggguucucccgucuuacuccggcagaaacgugccuaauguacaccuggcaccagccgucgcucccaccuucccuggugagcaguuacuguuuuucaggagcacuaugcccgggugcucgggcuauccaaacauggaccucgauugucuucugccucaggagugggugcagcauuuuuaccaagaagcggcacccgcccagucugacguugcuuugcuacgguucgugaauccagauacgggacguguccuguuugagugcaaacuccacaagccgggcuaugugacaguagcccauaccgggcagcacgaccuggugauuccuuccaacggauacuuccgcuuugauucauggguuaaccaguucuauacucuugcacccauggguaauggcaccgggagaaggcgguga

SEQ ID NO: 21302 - RNA, 1617 nt, Artificial Sequence
  derived and/or modified sequence opt3 from VP1__Norovirus_and/or_Norovirus-like__AB504323
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaaucgacguucgccaacuggagccagugcuuauuccccugccugauguccgaaacaauuuuuaucacuacaaccagucaaaugacagcaccaucaaguugauugcuaugcucuauacaccacugcgugccaacaacgcgggggaagauguguucacugugaguugcagaguccugaccaggcccucccucgacuuugauuucaucuuuuuaguuccgccuacaguggagucucggaccaaacccuucacuguaccaauacugacaguggaagagaugaccaauagccgcuuuccuauuccccuugagaaguuguucacgggaccauccggugccuucgucgugcagccccagaacggcagauguacuaccgacgggguucugcuaggaacaacucaacucucaccugugaauaucugcacccugaggggcgaugucacacauauugcagguagucggaacuacaccaugaaucuugcuagccugaacuggaauaacuaugacccaacggaagagaucccggcccccuuggggacuccugauuuugugggaaaaauccagggcguacucacacagaccacuaagggcgacgggucuacacgcggacacaaggcuaccguuuacacggguuccgccccauucacccccaaacugggcucagugcaguuuagcacagacacugaaaaugauuucgagacccaucaaaacacaaaguuuacuccugucggggugauucaggacggaaguaccacacaccgaaaugaaccacagcaaugggucuuacccucuuacuccggcagaaacgugcacaauguucaucuggcaccggccguggcuccuaccuucccaggugagcagcuccuguuuuucaggagcacuaugcccggguguucgggcuauccuaacauggaucuugacugcuugcuaccccaggaguggguacagcacuuuuaccaagaagcggcaccagcccagucugaugucgcucugcuccgguucgugaauccugacacgggacguguucuguuugaguguaaacuucauaaguccggcuaugugacagucgcccacaccgggcagcacgaucuggugauacccccaaacggauacuuccgcuuugacucauggguaaaccaguucuauacuuuggcaccgauggguaauggcaccgggagaaggcgguga

SEQ ID NO: 21303 - RNA, 1617 nt, Artificial Sequence
  derived and/or modified sequence opt3 from VP1__Norovirus_and/or_Norovirus-like__KX353963
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccaggacacaaaauucacuccagucggugugauccaggauggcuccaccacacccaggaaugaaccgcaacaguggguuuugccuagcuacucggggcggaacauccauaaugugcaccucgccccagcaguagcccccaccuuuccuggagagcagcuguuauucuuucguucuacuaugcccggcuguuccgguuauccaaacauggaccuggauugccuccuuccucaggaauggguccaauacuucuaucaggaggcugcgcccgcacagucagacguggcccuguugcgcuuuguuaauccagauacggggagagugcuauucgaguguaagcugcacaaaaguggcuacgucacaguggcucauaccggacagcacgaccucguaauuccgccuaacggcuauuuuagguucgauagcugggugaaccaauucuacacucuggcccccauggggaauggaaccggucggcgacgcuga

SEQ ID NO: 21304 - RNA, 1617 nt, Artificial Sequence
  derived and/or modified sequence opt3 from VP1__Norovirus_and/or_Norovirus-like__KR904213
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaauuccgccuaacggcuauuuuagguucgacagcugggugaaucaauucuuuucccuggcccccauggggaacggaacuggucggcgacgcuga

SEQ ID NO: 21305 - RNA, 1617 nt, Artificial Sequence
  derived and/or modified sequence opt3 from VP1__Norovirus_and/or_Norovirus-like__AB933745
augaagauggccagcaaccacgugaaucccuccgacggcucuaccgcuaaccuggucccugagguuaauaacgaagugauggcacucgagccaguagugggggccgcgaucgcugccccggucgcaggacagcaaaaugugauugaucccuggauaagaaacaauuucguucaggccccugguggcgaauuuacagugucaccaaggaacgcucccggggagauccuuuggagugcaccucugggaccagacuugaaucccuacuuaagccaucuggcccggauguauaacggcuacgcugguggguucgaaguccaggugauucuagccggaaaugcguuuacugcaggcaaaaucauuuucgccgcuguaccuccaaacuuuccgacggagggccucucccccucucagguuaccauguucccucacaucauaguggauguccgccaacuggagccagugcuuaucccccugccugacgugcgaaauaacuuuuaucauuacaaucagucgaacgauccaacaauuaaguugaucgccaugcucuauacuccccugcgugcaaacaaugcuggggacgaugucuucaccguuucaugcagagugcugacaaggccgagcccugacuuugauuucauuuuucucguacccccaaccguggaaagucggacuaaaccuuucuccguccccguguuaacaguugaggaaaugaccaacucucgcuuuccaaucccccuggagaaacuuuucacgggaccuagcuccgccuucgugguccagccacagaaugguagauguacuaccgacggcguguugcuggggacaacucaacuaucaccgguaaacauaugcaccuuuaggggagauguuacacacauucccggcagucggaauuacaccaugaaccucgcgagccagaauuggaacucuuaugacccuacggaggaaaucccagcaccccuggguacuccugauuucguggggaagauucagggaguccuuacacagaccacucgcacaaauggcuccacccgaggccauaaggccacgguguacaccgggucagcugacuuuagcccaaagcugggaagaguccaauucgccacagacacugauaacgacuuugagaccaaucagaacacaaaauucacucccguggguguuauccaggauggcaguaccacaccgaggaaugaaccucaacaguggguguugccaucuuacuccgggcggaacauccacaauguacaccucgcucccgccgucgcaccuaccuuucccggagagcagcuguuauucuuucguagcauuaugccaggcuguucggguuauccuaacauggaccuggauugccuccuuccccaggaaugggugcaauacuucuaucaggaggccgcuccagcgcagucugacguugcacuguugcgcuuugugaacccggauacugggagaguccuauucgaguguaagcugcauaaauccggcuacgugacgguagcccacacaggacagcaugaccucgugauaccucccaauggcuauuuuagguucgauucauggguuaaccaauucuacacccuggcuccaauggggaauggaacuggucggcgacgcuga

SEQ ID NO: 21306 - RNA, 1617 nt, Artificial Sequence
  derived and/or modified sequence opt3 from VP1__Norovirus_and/or_Norovirus-like__KP096341
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggaaugcuuacacagaccacucgcacagacggcucaacccgaggccacaaggccacgguguacaucgggggagcugauuuugccccuaagcuggguagaguccaauucgagaccgacacagaucaugacuuugaagcaaaccagaauacuaaauucaccccagugggcguuauucaggaugggagcacaacucacaggaacgagccccaacaguggguguugccgaguuacucuggacggaauaccccuaacguacaccucgccccagcugucgcgcccacauuuccuggcgaacagcuguuauucuuucguuccaccaugcccgguuguagcggguauccaaauauggaccuggauugccuccuuccucaggagugggugcaauacuucuaucaggaggcagcccccgcucagucggacguugcccuguugcgcuuugugaacccagauacuggcagaguccuauucgaauguaagcugcauaaaucuggauacgugacgguagcacacacaggccagcaugaccucgugaucccgccuaauggguauuuuagguucgauuccuggguuaaccaauucuacacccuggcccccaugggaaacgguacuggccggcgacgcuga

SEQ ID NO: 21307 - RNA, 1617 nt, Artificial Sequence
  derived and/or modified sequence opt3 from VP1__Norovirus_and/or_Norovirus-like__KM114291
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugccugcaccagguggcgaauuuaccguuagucccaggaaugccccuggggagauccuuuggagcgcuccacugggacccgauuugaacccuuacuuaucccaccuggcccggauguauaauggcuacgcggguggguucgaagugcaggucauucuagcaggaaacgccuuuacagcuggcaaagugaucuucgccgcaguaccaccgaauuuucccacugagggccucucuccuucgcagguuacgauguucccacauauuguggucgacgugcgccagcuggagcccgugcuuaucccucugccagauguccgaaacaauuuuuaucacuacaaccaaucaaaugaccccaccauaaaguugaucgcuaugcucuauacaccgcugcgugccaacaacgcgggggaugacguuuucacugugagcugcagaguacugaccaggccuagucccgauuuugacuucauuuuucucgugccaccuacagucgaaucccggaccaaacccuucucugugccaguuuuaacuguggaggaaaugacaaauagccgcuuucccaucccucuggagaaacuuuucaccggaccauccucagccuucgucgugcagccgcagaacgguagauguacgacugauggcguauugcugggggcaacccagcuaagucccguuaauauuugcacauuuaggggagacgugacucauaucaccggcagccggaacuacacaaugaaucucgcuucucaaaacugguccaauuaugauccuaccgaggaaauaccagcuccccuggguacgccugacuucgucgggaagauucagggagugcuuacucagacaacccgcacugacggcucaacacgaggccacaaggccaccgucuacacggggagcgccgauuuugcaccaaagcugggaagagugcaguucgagaccgacacagauagggacuuugaagccaaccaaaauacuaaauucacccccguuggugugauccaggauggcaguacaacucaucggaacgagccgcagcaauggguauugccuucuuacuccgggcguaauaccccaaacguccaccucgcucccgcgguggcaccuacauuucccggagaacagcuguuauucuuucgcagcaccaugccaggcuguucggguuauccuaauauggaccuggauugccuccuuccccaggaguggguucaguacuucuaucaagaggccgcuccagcccagucugacguggcacuguugagauuugucaacccggauacugggagggugcuauucgaauguaagcugcacaaauccggcuacguaacgguggcccauacaggacagcacgaccucguuauuccucccaauggcuauuuucgguucgauucaugggucaaccaguucuacacccuggcuccaauggggaacggaacuggucgacgcagauga

SEQ ID NO: 21308 - RNA, 1617 nt, Artificial Sequence
  derived and/or modified sequence opt3 from VP1__Norovirus_and/or_Norovirus-like__KF060105
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaaugugugcaccuuuaggggagacguaacacauauuccgggcucucacaacuacaccaugaaucucgccucccagaacuggaacucauaugaucccacggaggaaaucccugcaccacuggguacucccgacuucguugggaagauucagggagugcuuacacagaccacuagcacaaauggcaguacccggggccauaaggcuacggucuacaccgggucugccgacuuuuccccuaagcugggacgcgugcaauucgcuacagauacuaauaacgacuuugagaccaaucagaacacaaaauucacuccagucggugugauccaggauggcagcaccacaccccgaaaugaaccgcaacaguggguuuugccuucguacucugggagaaacauccacaaugugcaccucgccccagcaguagcccccaccuuuccuggagagcagcuguuauucuuuagguccacuaugcccggcuguucagguuauccaaacauggaccuggauugccuccuuccucaggaauggguccaauacuucuaucaggaggcugcgcccgcacagagugacguggcccuguugcgguuuguuaacccagauacggggcgugugcuauucgaguguaagcugcauaaaagcggcuacgucacaguggcucacaccggacagcaugaccucguaauuccgccuaauggcuauuuucgcuucgauuccugggugaaccaauucuacacucuggcccccauggggaauggaaccgguagaaggcgguga

SEQ ID NO: 21309 - RNA, 1617 nt, Artificial Sequence
  derived and/or modified sequence opt3 from VP1__Norovirus_and/or_Norovirus-like__KF060081
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucacaacuacaccaugaaucucgccucccagaacuggaacucauaugaucccacggaggaaaucccugcaccacuggguacucccgacuucguugggaagauucagggagugcuuacacagaccacuagcacaaauggcaguacccggggccauaaggcuacggucuacaccgggucugccgacuuuuccccuaagcugggacgcgugcaauucgcuacagauacuaauaacgacuuugagaccaaucagaacacaaaauucacuccagucggugugauccaggauggcagcaccacaccccgaaaugaaccgcaacaguggguuuugccuucguacucugggagaaacauccacaaugugcaccucgccccagcaguagcccccaccuuuccuggagagcagcuguuauucuuuagguccacuaugcccggcuguucagguuauccaaacauggaccuggauugccuccuuccucaggaauggguccaauacuucuaucaggaggcugcgcccgcacagagugacguggcccuguugcgguuuguuaacccagauacggggcgugugcuauucgaguguaagcugcauaaaagcggcuacgucacaguggcucacaccggacagcaugaccucguaauuccgccuaauggcuauuuucgcuucgauuccugggugaaccaauucuacacucuggcccccauggggaauggaaccgguagaaggcgguga

SEQ ID NO: 21310 - RNA, 1617 nt, Artificial Sequence
  derived and/or modified sequence opt3 from VP1__Norovirus_and/or_Norovirus-like__KF059999
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggagacggccccugcacagagcgacguggcucuguugcgcuuugucaaucccgauacaggcagagugcuauucgaauguaagcugcacaaaucgugcuacguaaccguggcccauacuggacagcacgaccucguuauuccaccgaacggcuauuuuagguucgauucuugggucaaccaauucuacacccuggcaccuauggggaauggaacaggucggcgacgcuga

SEQ ID NO: 21311 - RNA, 1617 nt, Artificial Sequence
  derived and/or modified sequence opt3 from VP1__Norovirus_and/or_Norovirus-like__JX644036
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaaacgcguucguugugcagccucagaaugguagauguacuaccgauggcgucuugcuggggacaacucaacuaaguccagugaacauaugcaccuuuaggggagacguaacacauauuccgggcagccggaauuacaccaugaaccucgccucucagaauuggaacuccuaugaucccacggaggaaaucccugcaccacuggguacucccgacuucguugggaagauucagggagugcuuacacagaccacucgcacaaauggcucaacccgaggccacaaggcuacggucuacaccgggagcgccgacuuuaguccuaagcugggaagagugcaauucgcuacagauacugacaacgauuuugagaccaaucagaacacaaaauucacuccagucggugugauccaggacggcucuaccacacccaggaaugaaccgcaacaguggguuuugccuuccuacagcgggcggaacauccauaaugugcaccucgccccagcaguagcccccaccuuuccuggagagcagcuguuauucuuucguucgacuaugcccggcuguucugguuauccaaacauggaucuggacugccuccuuccucaggaauggguccaauacuucuaucaggaggcugcgcccgcacaguccgauguggcccuguugcgcuuuguuaacccagacacggggagagugcuauucgaguguaagcugcacaaaucaggcuacgucacaguggcucauaccggacagcacgaucucguaauuccgccuaauggcuauuuuagguucgacaguugggugaaccaauucuacacucuggcccccauggggaauggaaccggucggcgacgcuga

SEQ ID NO: 21312 - RNA, 1617 nt, Artificial Sequence
  derived and/or modified sequence opt3 from VP1__Norovirus_and/or_Norovirus-like__JX459654
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagccucgauuuugacuucaucuuuuuagugccucccaccguagaaagucggacuaaaccauucuccgugccuguccugacaguggaggaaaugaccaacucucgcuuucccauuccacuugagaaguuguucacgggacccagcuccgcguucguugugcagccucagaaugguagauguacuaccgauggcguccugcuagggacaacucaacucucaccagugaacauaugcaccuuuaggggagacguaauucauaucccgggcagucggaauuacacaaugaaccuggccagccagaauuggaacucuuaugaucccaccgaggaaauuccugcaccacuugguacgcccgacuucguugggaaaauccagggagugcugacucagacaacccgcacuaauggcuccacacgaggccacaaggcuaccgucuacacggggucagccgacuuuagcccuaaguugggaagagugcaauucgcuaccgauacagacaacgauuuugagacuaaucagaacaccaaauucacaccagucggugugauccaggacggcaguacuacccccaggaaugaaccgcaacaguggguucucccuucuuacuccgggcggaacauucauaaugugcaccuggccccagcaguagcccccacauuuccuggagagcaguuacuguucuuucguagcaccaugcccggcuguucggguuauccaaacauggaucucgacugccuucugccucaggaauggguccaauacuucuaucaggaggcugcgcccgcacagucugauguggccuugcuacgcuuuguuaacccagacacugggagagugcuguucgaguguaagcuccacaaauccggcuacgucacgguggcucauacaggacagcacgaucugguaauaccgccuaauggcuauuuuagguucgacucaugggugaaccaauucuacacccuugcccccauggggaauggaacuggucggcgacgcuga

SEQ ID NO: 21313 - RNA, 1617 nt, Artificial Sequence
  derived and/or modified sequence opt3 from VP1__Norovirus_and/or_Norovirus-like__JN400621
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugauguucgaguguaagcuacacaaaaguggcuacgucacaguggcucauaccggacagcacgaucugguaauuccgccuaacggcuauuuuagguucgacagcugggugaaucaauucuacacucucgcccccauggggaacggaaccggucggcgacgcuga

SEQ ID NO: 21314 - RNA, 1617 nt, Artificial Sequence
  derived and/or modified sequence opt3 from VP1__Norovirus_and/or_Norovirus-like__AB541260
augaagauggccagcaacgacgcuaaucccuccgauggcucugcagccaaccuggugccugaggucaauaacgaaguuauggcgcucgagccagugguaggggcugccaucgcagccccgguggcugcacagcaaaaugucauugaccccuggauaagaaacaauuucgugcaggccccuggaggugaauuuaccguuucaccaaggaacgcucccagugagauccuuuggagcgccccucugggcccagauuugaaucccuacuuaucccacuucgcgcggauguauaacugcuacgcagggggauuugaagugcaggucauucuggccggcaaugcuuucacagccgguaaaaucauuuuugcagcugugccuccaaacuucccgacugaggggcuaucucccucgcagguaacgauguuuccucauaucauaguugacgugcgccaacucgagccaguccugaucccccuuccugaugugcgaaauaacuucuaucacuacaaucagucaaacgacagcaccauuaagcugaucgccauguuguauacaccacuccgugcgaacaaugccggagaagauguguuuacugucaguuguagaguucugaccaggcccuccccggacuucgauuuuauuuuccuggugccucccacaguagagucucggaccaaaccauuuacugugccuauccucacagucgaagagaugaccaacagccgcuuccccauaccauuagagaagcuguucacgggccccuccucagcauuugugguucagccucagaauggcagaugcacuaccgacggggugcuuuugggaacaacucaacugaguccagucaacauuuguaccuucaggggugaugugacacauaucgcuggcagccggaauuacaccaugaaccuagccucucucaauuggaacaauuaugacccgacggaagagauucccgcuccucuggggacuccagauuuuguaggaaaaauccagggcguucuuacacagaccacuaagggugacggguccacacgcggacacaaggccaccguguacacgggcucagcacccuucaccccuaaacugggcagcguccaguuuaguacagacacugaaaacgauuucgagacccaucaaaauacaaaguuuacuccagugggggucauccaggacggagguaccacacaccgaaacgaaccccagcaauggguguugccgucuuacuccggcagaaauguuccuaacgugcaccucgccccagcuguagcgcccaccuucccuggggagcagcuguuauuuuucaggagcacuaugcccggaugcucgggcuauccaaauauggaucuggacugucuccuuccucaggaguggguccagcauuuuuaccaagaagcagcccccgcucagucugauguggcccuguugcgguucguuaacccagacacgggucgugugcuauuugagugcaaacugcacaaguccggguaugucacaguggcacauaccggccagcacgaucucguaauuccgccuaacggauacuuccgcuucgacucaugggugaaucaguuuuauacucuggcccccaugggcaacgggaccggaagaaggcgguga

SEQ ID NO: 21315 - RNA, 1617 nt, Artificial Sequence
  derived and/or modified sequence opt3 from VP1__Norovirus_and/or_Norovirus-like__KX514341
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaacgcgggggaugacguguucaccgucagcugcagaguucugacaaggcccaguccggauuuugacuucauuuuucucgugccucccaccguagaaucccggucuaaaccauucagcgugccugucuuaacuguggaggaaaugacaaauucccgcuuucccgccacccuggauaaacuuuucacgggaccaucaaguacuuucguugugcagccccagaacgguagauguaugaucgacggcgucuugcuggggaccacacaacuaagcccugugaauauaugcacuuuuaggggagauguaacccagucuggcaacacaaagauuuacaccaugaaucucgcauccccaaacuggaauaacuaugacccgacggaggagauccccgcuccucuggguacuccagacuucguugggaagauucagggaaugcuuacacagaccacuaagggcgaaggcucaacacgggggcaucgcgccaccguguacgucggaagcgcuaauuacgcccccaaacugggucgagugcaauuugagacggauaccacagacgauuuggacgcacaccagaacacuaaguucaccccugucggcgugguucagaguggggaaucuccaaaaggauccgagccccaacagugggugcucccgagcuauucgggcagagauacaccuaauguacaucuggccccagcugucgcgcccacuuuuccuggugaacaguuacuguucuuuaggucuaccauccccggguguggcggacacccaaacaugaaucucgacugccuucugccucaggagugggugcaacacuucuaccaggaggcagcccccgcucaguccgauguugccuugcuacgguuugugaacccagacacaucacguguccuguucgaauguaagcuccauaaaaguggcuaugugaccguagcacacacugggcagcaugaucuggugaucccgccuaauggauacuuucgcuucgacagcuggguuaaccaauuuuauacgcuugcccccauggguaacggcacagggagaaagagguga

SEQ ID NO: 21316 - RNA, 1617 nt, Artificial Sequence
  derived and/or modified sequence opt3 from VP1__Norovirus_and/or_Norovirus-like__KX514253
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccaggcuugaaucccuacuuaagccaccuggcucggauguauaacgguuacgccgggggauucgaagugcaggucauucuagcgggcaaugcauuuacugccggcaaaaucauuuucgcugccgugccuccaaacuuuccgacggaggggcucaaucccucccagguaaccauguucccucauaucauaguugaugugcgccaacuggagccaguccuuaucccccugccugacgugcgaaacaauuuuuaucacuacaaccagucuaacgauucgacaauuaaguugaucgcaaugcucuauacuccacugcgugcuaauaacgccggagacgauguguucaccgucucaugcagaguucugacaaggcccagcccggacuuugauuucauuuuucucgugccucccaccguagaaagucgguccaaaccauucucugugccugucuuaacugugcaggagaugacaaauagccgcuuucccgcgacccuggacaaacuuuucacggguccauccucaaacuugguugugcagccccaaaauggcagauguaugaucgaugggguccugcuaggaacuacccagcucaguccugugaacauaugcacauucaggggcgacguaacucaucugcgggauagcaccauuuacacaaugaaucuugccucuccaaacuggaauaacuaugacccgaccgaagagauccccgcaccucuggguacgccagacuuuguugggaagauucagggaguguugacucagacaaccaagggcgagggcuccacucgcgggcaccgagcuacagucuacgugggaucagccgauuacacccccaagcucgguaaaguccaauucgaaacgaauaccacaaacgaccuguaugcucaucagaauacuaaguuuaccccugugggcguugugcaagggggagagagcgcccacagaagugaaccacagcaguggguauuacccggcuacucugguagggauacaccgaacguccaccuggccccugcaguggcuccaacuuuccccggggagcagcuccuguuuuuccgguccaccaucccuggcuguggaggccaucccaauauggaccuugauugcuugcuaccacaggaauggguucaacacuuuuaucaggaggcggccccugcacagagcgacguggcucugcuccguuucgucaaccccgauacaucgcgcgugcuguuugaguguaaacuucauaagucuggguacguaaccguggcccacacuggacagcacgaccugguuaucccaccgaacgguuauuucagauuugauuccugggucaaucaauucuacacguuggcaccuaugggcaacgggacaggaaggaaacgguga

SEQ ID NO: 21317 - RNA, 1617 nt, Artificial Sequence
  derived and/or modified sequence opt3 from VP1__Norovirus_and/or_Norovirus-like__KX514195
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauucuuacgcgggcgguuucgaagugcaggucauucuagcagggaacgccuuuacagcuggaaaaaucauuuucgccgcagugccuccaacuuuuccgacggagggccucucgcccucacagguaaccauguucccucauaucauaguugacgugcgccaacuggagccaguccuuaucccccugccugaugugcgaaauaacuuuuaucacuacaaucagagcaacgacaguacaauuaaguugaucgcuaugcucuauacuccacugcgugccaauaaccccggcgaugacguguucaccgucuccugcagaguucugacaaggccgucuccugauuuugacuucauuuuucucgugcccccaaccguagaaagccggacuaaaccuuucuccgugcccaucuuaacagucggggagaugaccaacucacgcuuuccaauaaaucuggaaagacuuuucacgggacccaguagcacuuuggugguucagccucagaacgguagguguaugauugauggcgugcugcuagggaccacacaacucucuccagucaauaucugcacuuuccggggagacgugacccauucccgcgauucaacaauuuacaccaugaaccuggcgagcccgaauuggaacaauuaugaccccacggaggagaucccugccccacuuggcacucccgacuuuguagguaagauccaggggguucugacacagaccacuaaaggagaaggcaguacacgaggccacagagcaaccguguacgucgggucugcuaacuacacgccuaaguugggaaaggugcaguucgagaccaauacaacuaacgaucucuaugcccaucaaaauaccagguuuacaccagucggugugguucagggcggggaauccgcucaccggagcgagccccagcaaugggugcugccgucguacucuggacgugacacuccuaacguacacuuagccccagcagucgcccccaccuucccuggcgaacagcugcucuuuuuccgcuccacaauucccgguugugggggccauccaaauauggaucuugacugccuguugccucaggagugggugcagcacuuuuaucaagaggcugcgcccgcacagucagauguugcccuacugagauucgugaacccagacaccaguaggguccucuuugaauguaaacugcauaagagcggauacgugacuguagcucacacgggccagcacgaucuugugauaccgccuaauggguauuuccgguuugacuccuggguuaaccaguucuacacacuggcccccaugggaaacgguaccggccgaaaacgcuga

SEQ ID NO: 21318 - RNA, 1617 nt, Artificial Sequence
  derived and/or modified sequence opt3 from VP1__Norovirus_and/or_Norovirus-like__KX354016
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggaggcgugacacauaucccggguucucacaacuacaccaugaaucucgccucccagaacuggucaagcuaugaccccacggaggaaauuccugcaccacuggggacucccgauuucguaggaaagauccagggcguucuuacacagaccacaaguacuaauggcucuacccgggggcauaaggcuacgguguacaccggauccgccgacuuuagcccuaagcugggucgcguccaauucgcuacagacacuaacaaugauuuugagaccaaccagaauacaaaauucacuccagugggcgucauccaggacgggucgaccacaccccgaaacgaaccgcaacaguggguguugccuucuuacuccggaagaaauauucacaacguucaccucgccccagcaguggcccccaccuuuccuggcgagcagcuguuauucuuuaggucaacuaugcccgguuguaguggguauccaaauauggaucuggacugccuccuuccucaggaauggguacaauacuucuaucaggaggcugcgcccgcacagagcgaugucgcccuguugcgguuugugaacccagacacgggccguguucuauucgaguguaagcugcauaaauccggauacgugacagucgcucacaccggccagcaugaucucgugauaccgccuaacggguauuuucgcuucgacucuuggguaaaucaauucuacacucuggcccccaugggaaacgguaccggcagaaggcgguga

SEQ ID NO: 21319 - RNA, 1617 nt, Artificial Sequence
  derived and/or modified sequence opt3 from VP1__Norovirus_and/or_Norovirus-like__KM245073
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucaucugaucguugacgugcgccaacuugagccaguccugauacccuugccugaugugcgaaacaauuuuuaucacuacaaccagucaaaugacagcacaaucaagcucauugcaaugcuguauacuccacugcgugcuaacaacgccggggaugacguguucaccgucaguugcagaguucucacaaggcccuccccggauuuugacuucaucuuuuuagugccucccaccguagaaucucggacuaaaccauucagcgugccuguccugacaguggaggaaaugaccaauucccgcuuucccauuccacuugagaaguuguucacgggacccucaagugcguucguugugcagccucagaacgguagauguacuaccgauggcguccugcuagggacaacucaacucagcccagugaauaucugcaccuuuaggggagacguaacacauauaccgggcucucggaacuacaccaugaaucuggccucccagaacuggaacucauaugaucccacggaggaaauuccugcaccacuugguacucccgacuucguugggaaaauccagggagugcugacacagaccacucgcacaaauggcagcacccgaggccacaaggcuacggucuacaccgggagugccgacuuuucuccuaaguugggaagagugcaauucgcuacagauacugacaaugauuuugagaccaaccagaauacaaaauucacuccagucggugugauucaggacggcuccaccacacccaggaacgaaccgcaacaguggguucucccuagcuacucggggcggaauauccauaacgugcaccuggccccagcaguagcccccaccuuuccuggagagcaguuacuguucuuucguucuacuaugcccggcuguuccgguuauccaaauauggaucucgacugccuucugccucaggaauggguccaauacuucuaucaggaggcugcgcccgcacagucagauguggccuugcuacgcuuuguuaacccagacacggggagagugcuguucgaguguaagcuccacaaaaguggcuacgucacaguggcucauaccggacagcacgaucugguaaucccgccuaacggcuauuuuagguucgacagcugggugaaucaauucuacacucuugcccccauggggaacggaaccggucggcgacgcuga

SEQ ID NO: 21320 - RNA, 1617 nt, Artificial Sequence
  derived and/or modified sequence opt3 from VP1__Norovirus_and/or_Norovirus-like__LN854567
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagauuucgucgugcagccacagaacgguagauguacgacugacggcguauugcuggggaccacacaacuaaguccgguuaauauuugcacuuuuaggggagaugugacccauacaaccggcagccggaacuacacgaugaaucucgccucucagaacuggaauaacuaugaccccacugaggaaaccccugcaccacuggguacacccgacuucgucgggaagauccgcggaaugcuuacucagacaacccgagcugauggcuccacgagaggccacaaggccaccguguacacagggucagcugacuuugccccuaagcugggaaggguccaguucgagacugauaccgacaaugauuuugacgcaaaccaaaauacaaaauucacuccaguggguguuauacaggauggcaccacaacccaucggaacgaaccccgucaguggguguugccgagcuacagugggcgcaauacucacaacguacaccucgccccugcugucgcgccaacguuucccggagagcaacuguuauucuuuagaucuacaaugccuggcuguuccgguuaucccaauauggaccuggauugccuccuuccacaggaaugggugcaguucuuuuaccaggaggcagccccugcucaaagcgacguugcccuguugagguucgugaaccccgauaccgggcggguccuauuugaguguaagcugcauaaaucgggcuaugugacuguagcacacaccggaccacaugaccucgugauuccgccuaacggcuacuuccgauucgacucuuggguuaaucaguuuuauacacuggcccccauggggaacggaaccggucgcagaagguga

SEQ ID NO: 21321 - RNA, 1617 nt, Artificial Sequence
  derived and/or modified sequence opt3 from VP1__Norovirus_and/or_Norovirus-like__JN400619
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccuugcggugaauuuacaguuaguccaaggaaugcacccggcgagauccuuuggagcgccccucuggggccagauuugaaccccuacuuaucccaccuggcucggauguauaauggauacgccggcgguuucgaagugcaggucauucuagcggggaacgcauuuacugccggaaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggcgaugacguguucaccgucaguuguagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacggggcccucaagugcguucguugugcagccucagaacggaagaugcacuaccgauggugucuugcugggcacaacucaacuaagcccagugaauauauguaccuuuaggggagacguaacacauauuccggggucucggaacuacaccaugaaucucgccucccagaacuggaacucauaugaucccacggaggaaaucccugcaccacugggcacucccgacuucguugguaagauucagggggugcuuacacagaccacucgcacaaauggaagcacccgaggccacaaggcuacggucuacaccggcagugccgacuuuucuccuaagcuggggagagugcaauucgcuacagauacugacaaugauuuugagaccaaccagaauacaaaauucacuccagucggagugauccaggacgguuccaccacacccaggaacgaaccgcaacaguggguuuugccuagcuacucgggccggaauauccauaacgugcaccucgccccagcaguagcccccaccuuuccuggggagcagcuguuauucuuucguucuacuaugcccggaugcuccggcuauccaaauauggaucuggacugucuccuuccucaggaauggguccaauacuucuaucaggaggcugcgcccgcacagucagauguggcccuguugcgcuuuguuaacccagacacggguagagugcuauucgagugcaagcugcacaaaaguggguacgucacaguggcucauaccggccagcacgaucucguaauuccgccuaacggauauuuuagguucgacagcugggugaaucaauucuacacucuggcccccaugggcaacgggaccggacggcgacgcuga

SEQ ID NO: 21322 - RNA, 1617 nt, Artificial Sequence
  derived and/or modified sequence opt3 from VP1__Norovirus_and/or_Norovirus-like__KF060052
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaauuccugcaccacuggguacucccgacuucguagggaagauccagggaguucuuacacagaccacuagcacaaauggcaguacccggggccauaaggcuacgguguacaccgggucugccgacuuuuccccuaagcugggacgcguccaauucgugacagauacuaauaacgacuuugagaccaaucagaacacaaaauucacuccagucggugugauccaggauggcagcaccacaccccgaaaugaaccgcaacaguggguuuugccuucguacucugggagaaacauucacaaugugcaccucgcuccagccguagcacccaccuuuccuggagagcagcuguuauucuuuagguccacuaugcccggcuguucagguuauccaaacauggaccuggauugccuccuuccucaggaauggguccaauacuucuaucaggaggccgcucccgcgcagagugacguggcacuguugcgguuuguuaacccagauacggggcgugugcuauucgaguguaagcugcauaaaagcggcuacgucacaguggcccacaccggacagcaugaccucguaauaccgccuaauggcuauuuucgcuucgauuccugggugaaccaauucuacacucuggcucccauggggaauggaaccgguagaaggcgguga

SEQ ID NO: 21323 - RNA, 1617 nt, Artificial Sequence
  derived and/or modified sequence opt3 from VP1__Norovirus_and/or_Norovirus-like__KF060014
augaagauggccagcuccgacgcuaaccccucugauggcucaaccgcaaaucuggugccugaggucaguaacgaaguuauggcccucgagccagugguaggggcggcuaucgccgcaccgguggccggacagcaaaaugucauugaccccuggauaagaaacaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacaguacaauuaaguugaucgcaaugcucuauacuccacugcgugcuaauuccgccggggaugacguguucaccgucucuugcagaguucugacaaggcccagcccggauuuugacuucauuuuucucgugccucccaccguagaaucccggacuaaaccauucucagugccuaucuuaacagucgaggaaaugaccaacagucgcuuucccauaccacuggagaaacuuuucacgggacccagcucugcguucgugguucagccucagaacgguagauguacuaccgauggcguguugcuggggacaacucaacuauccccagucaauauuugcaccuuuaggggagacgugacacauaucccgggcucacacaacuacaccaugaaucucgccagccagaacuggaauaguuaugaucccacggaggaaauuccugcaccacuggguacucccgacuucguagggaagauccagggaguucuuacacagaccacuucuacaaacggcuccacccggggccauaaggcuacgguguacaccgggagcgccgacuuuucgccuaagcugggacgcguccaauucgcuacagauacuaauaacgacuuugagaccaaucagaacacaaaauucacuccagugggugucauccaggauggcucuaccacaccccgaaaugaaccgcaacaguggguguugccuuccuacucagggagaaacauucacaauguucaccucgccccagcaguggcccccaccuuuccuggagagcagcuguuauucuuuaggaguacuaugcccggcuguagcgguuauccaaacauggaccuggauugccuccuuccucaggaauggguacaauacuucuaucaggaggcugcgcccgcacaguccgacgucgcccuguugcgguuugugaauccagauacggggcguguucuauucgaguguaagcugcauaaaucuggcuacauaacaguggcucacaccggacagcaugaccucgucaucccgccuaacggcuauuuucgcuucgauagcugggugaaccaauucuacacucuggcccccauggggaauggaaccgguagaaggcgguga

SEQ ID NO: 21324 - RNA, 1617 nt, Artificial Sequence
  derived and/or modified sequence opt3 from VP1__Norovirus_and/or_Norovirus-like__KC517375
augaagauggccagcuccgacgcuaaccccucugauggcucagcagccaaucuggugccugaggucaacaaugaaguuauggcgcucgagccaguggcuggggccgcaaucgccgcuccgguagcaggacagcaaaacgugauugaccccuggauaagaaauaacuucguccaggccccugguggcgaauuuaccgugaguccaaggaaugcucccggggagauccuuuggagcgccccucugggaccagauuugaaccccuacuuaucccaccuggcgcggauguauaauggcuacgccgguggguucgaaguucaggugauucuagcaggaaacgcuuuuacagccggcaaagucaucuucgcagcugugccuccaaauuuuccgacugagggccucucucccucgcagguaacgauguucccucauauuguuguggacguccgccaacuggagccagugcuuaucccccugccugaugugcgaaacaauuuuuaucacuacaaccagucaaaugacccaaccauaaaguugaucgccaugcucuaugcgccccugcgugccaacaacgcaggggaugacgucuucacaguuagcugcagagugcugacuaggccgaguccugauuuugacuucauuuuucucguacccccaaccguggaaucccggacaaaaccuuucucuguccccguguuaaccguugaggaaaugacuaauagccgcuuuccaaucccccuggagaaacuuuucacaggaccuuccucagcuuucgugguccagccacagaacgguagauguaccacggauggcguguugcuggggacuacccaacuaaguccgguaaauauuugcacauuuaggggagacguuacucauaucaccggcagccggaacuacacaaugaaucucgccucucagaacuggaauaacuaugaucccaccgaggaaauaccugcuccacuggguacgcccgacuucguggggaagauucagggaguccuuacucagacaacccgcacugacggcuccacacgaggccacaaggccaccguguacacggggucagcagauuuugccccuaagcugggaagaguccaauucgagaccgacacagaucaugacuuugaagcuaaucagaacacuaaauucaccccaguggguguuauccaggauggcgggacaacucacaggaaugagccccaacaguggguguugccgagcuacaguggacggaacacccacaauguacaucucgcgccugcagucgccccaacauuucccggcgaacagcuguuauucuuucguucuaccaugccugguuguuccggguaucccaacauggaccuggauugccuccuuccacaggagugggugcaauacuucuaucaggaggcugccccugcacagagcgacguugcccuguugcgcuuugugaaucccgauacuggcagaguccuauucgaauguaagcugcacaaaucgggauacgugacgguagcucauacaggccagcacgaccucgugauuccaccgaacggguauuuuagguucgauucuuggguuaaccaauucuacacccuggccccuaugggaaaugguacuggccggcgacgcuga

SEQ ID NO: 21325 - RNA, 1617 nt, Artificial Sequence
  derived and/or modified sequence opt3 from VP1__Norovirus_and/or_Norovirus-like__JX644039
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucucuggcucccggaacuacaccaugaaucucgccucacagaacuggacgagcuaugauccgacugaggaaauucccgcaccucuggguacaccagacuucguagggaagauccagggaguucuuacccagacuacacgcaccaauggcaguacgcgaggccacaaggcuaccguguacacagggucugccgacuuuucccccaagcugggaagaguccaauucgcuacugauaccgacaacgauuuugagacaaaucagaacacuaaauucaccccugugggugucauccaggacggcagcacaaccccaaggaaugaaccccaacaguggguguugccgucguacucugggcggaacauucauaauguucaccucgccccugcaguggccccaacuuuucccggagagcagcuguuauucuuucguuccacgaugccuggcuguucagguuaucccaacauggaucuggacugccuccuuccacaggaauggguacaauacuucuaucaggaggcugcgccugcacagagugaugucgcccuguugcgcuuugugaaucccgacacagggagaguucuauucgaguguaagcugcacaaaagcggcuacgugaccgucgcucauacuggacagcacgaucucgugauaccaccgaacggcuauuuuagguucgacuccuggguaaaccaauucuacacccuggccccuauggggaauggaacaggucggcgacgcuga

SEQ ID NO: 21326 - RNA, 1617 nt, Artificial Sequence
  derived and/or modified sequence opt3 from VP1__Norovirus_and/or_Norovirus-like__JX644031
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggucaagcuaugaucccacggaggaaaucccugcaccacuggguacucccgacuucguugggaagauucagggagugcuuacacagaccacucgcacaaauggcaguacccgaggccacaaggcuacggucuacaccgggucugccgacuuuuccccuaagcugggaagagugcaauucgcuacagauacugacaacgauuuugagaccaaucagaacacaaaauucacuccagucggugugauccaggacggcagcaccacacccaggaaugaaccgcaacaguggguuuugccuucguacucugggcggaacauccauaaugugcaccucgccccagcaguagcccccaccuuuccuggagagcagcuguuauucuuucguuccacuaugcccggcuguucagguuauccaaacauggaucuggacugccuccuuccucaggaauggguccaauacuucuaucaggaggcugcgcccgcacagagugauguggcccuguugcgcuuuguuaauccagacacggggagagugcuauucgaguguaagcugcacaaaagcggcuacgucacaguggcucauaccggacagcacgaucucguaauuccgccuaacggcuauuuuagguucgacuccugggugaaccaauucuacacucuggcccccauggggaauggaaccggucggcgacgcuga

SEQ ID NO: 21327 - RNA, 1617 nt, Artificial Sequence
  derived and/or modified sequence opt3 from VP1__Norovirus_and/or_Norovirus-like__HM191773
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccugucucggauguauaauggcuacgcugguggguucgaagugcaggucauucuagccggaaacgcguuuacugcaggcaaaaucauuuucgccgcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacgggaccuucaagugccuucguugugcagccacagaacgguagauguacuaccgauggcgucuugcuggggacaacucaacuaagcccggugaauauaugcaccuuuaggggagacguaacacauauucccggcucucggaacuacaccaugaaucucgcgucccagaacuggaacucauaugauccuacggccgagaucccagcaccccuggguacuccugacuucguugggaagauucagggagugcuuacacagaccacucgcacaaauggcagcacccgaggccacaaggcuacggucuacaccgggagugccgacuuuucuccaaagcugggaagagugcaauucgcuacagauacugacaaugauuuugaaaccaaccagaauacaaaauucacucccgucggugugauccaggacggcuccaccacaccgaggaacgagccucaacaguggguuuugccaagcuacucggggcggaauauccauaacgugcaccucgcccccgcaguagccccuaccuuucccggagaacagcuguuauucuuucguucuacuaugccaggcuguuccgguuauccuaauauggaucuggacugccuccuuccccaggaguggguccaauacuucuaucaggaagcugcgccagcacagucagauguggcccuguugcgcuuuguuaacccggacacggggagagugcuauucgaguguaagcugcacaaaaguggcuacgucacaguggcucauaccggacagcacgaucucguaauuccucccaacggcuauuuuagguucgacagcugggugaaucaauucuacacucuggccccaauggggaacggaaccggucggcgacgcuga

SEQ ID NO: 21328 - RNA, 1617 nt, Artificial Sequence
  derived and/or modified sequence opt3 from VP1__Norovirus_and/or_Norovirus-like__AB504309
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaguucuuacucagacaacccgaggcgacggcucuacgagagggcacaaggcuaccguguccacaggaucagucgauuuuacuccuaagcuggguagcgugcaauucgccaccgacacagauaacgacuuugagacuggccagaauaccagguucacaccagucggggugauccaggauggaaguucugcucaucggaacgaaccccaacaguggguuuugccggacuacuccggccguaccgugcacaauguacaccucgccccugcagucgccccaacuuuucccggugagcagcuguuauucuuucgcuucacgaugccuggguguagcggcuaccccaacauggaucuggacugccuccuuccacaggaaugggugcaacauuuuuaucaggaggcugcgccugcacagucggauguugcccuguugagauucgugaaucccgacacaggaaggguccuauuugaguguaaacugcacaagaccggcuacgugacuguagcucauaccgggcagcacgaucucgugauuccaccgaacggauauuuccgguucgacucuuggguuaaucaauuuuacacacuggccccuauggguaacggcgcagggcgacgcagauga

SEQ ID NO: 21329 - RNA, 1617 nt, Artificial Sequence
  derived and/or modified sequence opt3 from VP1__Norovirus_and/or_Norovirus-like__KX514216
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaagcuguucaccggaccaucaaguacguucguugugcagccccagaaugguagauguaugaucgacggcgucuugcuggggacuacccaacuaagcccugugaacauaugcacauuuaggggagauguaacucaucuccgggacucuccaauuuacaccaugaaucuggcauccccgaacuggaauaacuaugacucaacagaggagauccccgcuccucuuggcaccccagauuucguugguaaaauucagggggugcugacgcagacuacaaagggagaaggcagcacccgcggccaccgagccacugucuacguggggagugcuaauuacacacccaaguugggaaaaguccaguuugagaccaacacgaccaaugaccucuaugcccaucaaaacacaaaguucacuccuguggguguugugcagggcggggaaucugcacacagauccgagccacagcaauggguacugcccggauacagcggcagggauaccccgaauguccacuuagccccugcuguggcgccaacauuucccggugaacagcuucucuucuuucggucgacuaucccuggguguggcggacaucccaacauggaccuugauugccuguugccacaggaguggguucagcacuucuaucaagaggcagccccugcucagucugacguggcccuacugcguuuugucaaucccgauaccucccgcguacucuucgaauguaaacugcauaagucaggcuacgugacaguggcacacaccgggcagcacgaccuuguuaucccaccgaacggauauuuuagauucgauaguugggucaaccaguuuuacacucuggccccuauggguaauggcacggggaggaaacgguga

SEQ ID NO: 21330 - RNA, 1617 nt, Artificial Sequence
  derived and/or modified sequence opt3 from VP1__Norovirus_and/or_Norovirus-like__KX514212
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagaauugaaucccuacuuaagccaccuggcccggauguauaacggcuacgcggguggguucgaggugcaggucauucuagcaggaaaugccuuuacagcuggcaaaaucauuuucgccgcagugccuccaaacuuuccgacugagggccucucccccucucagguaacgauguucccucauaucauaguugaugugcgccaacuggaaccaguccuuaucccccugccugacgugcgaaauaacuuuuaucacuacaaucagucgaacgauucaaccauuaaguugaucgcuaugcucuauacaccacugcgugccaacaaugcgggggacgauguguucacugucagcugcagaguucugaccaggcccaguccggacuuugauuucauuuuucucgugccucccacaguagagucccggucuaaaccauucagcgugccugucuuaaccgugcaggaaaugacuaacucccgcuuucccgccacacuggacaaacuuuucaccggaccaucaaguaauuugguugugcagccccaaaacgguagauguaugaucgauggcguccugcuagggacgacucagcucagcccugugaauauaugcaccuucaggggagacguaacacauccacgggauucuccgauuuacacuaugaaccuggcaucccccaauuggaacaauuaugacccuaccgaggagaucccagcuccccuuggcacaccugacuuuguugguaagauucagggggugcugacccagacgacuaagggagaaggcucaacacgcggccaccgagccaccgucuacguggggagcgcuaacuacacuccaaaguugggaaaaguccaauucgagacaaauaccacgaacgaucucuaugcccaucagaauaccaaguuuacacccguggguguugugcagggcggggaaagugcacacagaucugagccgcaacaguggguacugccuggauacuccggcagggacacuccaaacguccacuuagcccccgcuguggcgccuaccuuccccggugaacagcugcucuuuuuccggagcacaaucccaggguguggcggacauccuaauauggaucuugacugccuguugccccaggaguggguucaacacuuuuaucaggaggcagccccagcucagucggauguggcccuacugcguuucgucaacccggacacuucucgcgugcucuuugaauguaaacugcauaaguccggcuacguaaccguggcacacacagggcagcacgaucuuguuaucccucccaacggauauuucagauuugacucaugggucaaucaauucuacacccuggccccaauggguaacggcacugggaggaaacgguga

SEQ ID NO: 21331 - RNA, 1617 nt, Artificial Sequence
  derived and/or modified sequence opt3 from VP1__Norovirus_and/or_Norovirus-like__KX354138
augaagauggccagcuccgacgcuaaccccucugauggcucagcagccaaucuggugccugaggcgaacaaugaagucauggcucucgagccaguugugggggccgcaaucgccgcuccgguagcaggacagcaaaacgugauugaccccuggauaagaaauaacuucguccaggccccugguggcgaauuuaccaucaguccaaggaaugcucccggggagauucuuuggagcgccccucugggaccagauuugaaccccuacuuaucccaccuggcgcggauguauaauggcuacgccgguggguucgaagugcagguuauccuagcaggaaacgcuuuuacagccggcaaagugauuuucgcagcugucccuccaaauuuuccgacugccggccucucucccucacaggugacgauguucccuucgaucguaguugacgugcgccaacuggagccaguccuuauaccccugccugaugugcgaaacaauuuuuaucauuacaaccagagcaaugacccaaccaucacauugauugcgaugcucuauacuccccugcgugccaacaacgcaggggaugacguguucaccgucaguugcagaguucugacaaggccguccccugauuuugacuucaucuuucucgugcccccaaccguagagucucggacuaagccuuucagcgugcccgucuuaacaguggaagagaugaccaauucccgcuuuccaauuccccuggaaagacuuuucacgggaccuucaagugcuuucguugugcagccacagaacgguagguguacuaccgauggcgucuugcuggggacaacucaacuaagcccggugaauaucugcaccuuucggggagacauaacacacauuaccggcucucauaacuacacgaugaaucucgccucccagaacuggaauaacuaugaucccacugaggagaucccugcuccacuggguacacccgacuucguagggaaaauucagggaguucuuacccagacuacacgcggcgacggcucaacccgagggcacaaggccacgguguacaccggaagcgcagauuuuaguccuaaacuggguagaguccaauucgaaacagacacuaaucaugauuuugaggccaaccagaauaccaaguucacaccagugggcgucauccaggacgggucuacuacccacaggaacgaaccccaacaguggguguugccguccuacagcggacggaauacacacaacguucaucucgcuccugcgguggcaccaaccuuucccggcgagcagcuguuauucuuucguucgacuaugccugguuguucuggguaucccaauauggaucuggacugccuccuuccacaggaauggguacaauacuucuaucaggaggccgcuccugcccaguccgaugucgcacuguugcgcuuugugaaccccgacacgggcagaguucuauucgaguguaagcugcacaaaucaggauacaucacaguggcccauaccggccagcacgaucucgucauuccaccgaacggguauuuuagguucgacaguugggugaaucaauucuacacucuggcuccuaugggaaacgguaccggccggcgacgcuga

SEQ ID NO: 21332 - RNA, 1617 nt, Artificial Sequence
  derived and/or modified sequence opt3 from VP1__Norovirus_and/or_Norovirus-like__AB933747
augaagauggccagcuccgacgcuaaccccuucgauggcucuaccgcaaaucuggugccugaggucaacaaugaaguuauggcccucgagccagugguaggggcggcuaucgccgcaccgguggccggacagcaaaacgucauugaccccuggauaagaaauaacuuugugcaggcuccugguggcgaguucacaguuucaccaaggaaugcacccggggaaauccuuuggagugccccucugggaccagauuugaaccccuacuuaagccaccugucccggauguauaauggcuacgcugguggguuugaagugcaggucauucuagccggaaacgcguucacugcaggcaaaaucauuuuugccgcugugccuccaaauuucccgacggagggccucucucccucgcagguaaccauguuuccucauaucauaguugacgugcgccaacuggagccaguccuuaucccccugccugaugugcgaaacaauuucuaucacuacaaccagucaaaugacccaacaauuaaguugaucgccaugcucuauacuccccugcgugcaaacaacgcuggggaugacguguuuaccgucagcugcagaguucugacaaggccgaguccugauuucgacuuuauuuuccucgugcccccaaccguagaaucccggacuaaaccuuuuucugugcccgucuuaacaguggaggaaaugaccaauagccgcuucccaaucccccuggagaaacuuuucacgggaccuuccucagccuuuguugugcagccacagaacgguagauguacuaccgauggcgucuugcuggggacaacucaacuaaguccggugaauauaugcaccuucaggggagacguaacacauauucccggcagccggaacuacaccaugaaucucgcgucucagaacuggaacuccuaugauccuacggaggaaaucccagcaccccuggguacuccugacuuuguugggaagauucagggagugcuuacacagaccacucgcacaaauggcucaacccgaggccacaaggccacggucuacaccgggagcgcugacuucaguccaaagcugggaagagugcaauuugccacagauacugacaaugauuucgagaccaaccagaauacaaaauuuacucccgucggugugauccaggacggcucuaccacaccgaggaacgaaccucaacaguggguuuugccauccuacagcgggcggaauauccauaacgugcaccucgcucccgccguagcaccuaccuuccccggagagcagcuguuauuuuuccguucgacuaugccaggcuguucugguuauccuaauauggaucuggacugccuccuuccccaggaauggguccaauacuuuuaucaggaggccgcuccagcgcaguccgauguggcacuguugcgcuucguuaacccggacacggggagagugcuauuugaguguaagcugcacaaaucaggcuacgucacaguggcccauaccggacagcacgaucucguaauuccucccaacggcuauuucagguucgacaguugggugaaucaauuuuacacucuggcuccaauggggaacggaaccggucggcgacgcuga

SEQ ID NO: 21333 - RNA, 1617 nt, Artificial Sequence
  derived and/or modified sequence opt3 from VP1__Norovirus_and/or_Norovirus-like__KJ955493
augaagauggccagcuccgacgcuaaccccucugauggcucagcagccaaucuggugccugaggucaacaaugaaguuauggcgcucgagccauucgugggggcugccaucgcagccccgguagcuggacagcaaaacgugauugaccccuggauaagaaauaacuuuguccaggcaccugguggcgaguucaccgugaguccaaggaaugcccccggggaaauccuuuggagcgcuccucugggaccagauuugaaccccuacuuaucccaccuggcccggauguauaauggcuacgcggguggguuugaaguucaggugauucuagcaggaaacgccuucacagcuggcaaagucaucuuugccgcagugccuccaaauuucccgacugagggccucucucccucgcagguaacgauguuuccucauauuguuguggacguccgccaacuggagccagugcuuaucccccugccugaugugcgaaacaauuucuaucacuacaaccagucaaaugacccaaccauaaaguugaucgcuaugcucuauacaccccugcgugccaacaacgcgggggaugacgucuuuacuguuagcugcagagugcugaccaggccgaguccugauuucgacuuuauuuuccucguacccccaacaguggaaucccggaccaaaccuuuuucuguccccguguuaacuguugaggaaaugacaaauagccgcuucccaaucccccuggagaaacuuuucaccggaccuuccucagccuuugugguccagccacagaacgguagauguacgacugauggcguguugcuggggaccacacaacuaaguccgguaaauauuugcacuuucaggggagacguuacccauaucacaggcagccggaacuacaccaugaaucucgcaucucagaacuggaauaacuaugaucugacggaggaaauacccgcuccucuugguacuccagacuuuguggggaagauucagggaguccugacacagaccacucgcacagacggcuccacccgaggccacaaggccacgguguacaccgggucagcugauuucgcccccaaguugggaagaguccaauuugagacagacacugaucaugacuucgaagcaaaucagaacaccaaauuuacaccuguggguguuauccaggauggcgggacuacccacaggagcgagccacaacagugggugcuccccaguuacucuggacggaauacaccgaacguacaccuggccccugcugucgcgccaaccuuccccggcgaacaguuacuguuuuuccguuccacuaugccugguuguagcggguaucccaauauggaccucgauugccuucugccacaggagugggugcaauacuuuuaucaggaggcagccccugcucagucggacguugccuugcuacgcuucgugaaccccgauacgggcagaguccuguuugaauguaagcuccauaaaucuggauacgugacaguagcacacaccggccagcaugaccuggugauuccaccgaauggguauuucagguucgauuccuggguuaaccaauuuuacacucuugccccuaugggaaacgguaccggccggcgacgcuga

SEQ ID NO: 21334 - RNA, 1617 nt, Artificial Sequence
  derived and/or modified sequence opt3 from VP1__Norovirus_and/or_Norovirus-like__KJ678153
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaccccacuggagaaacuuuucacgggacccucaagugccuucgucgugcagccucagaacgguagauguacuaccgauggcguauugcuggggacaacucaacuaagcccaguuaauaucugcaccuuuaggggagacgugacacauauuaccggcucucggaacuacacgaugaaucucgcaucccagaacuggucaaauuaugauccgacugaggaaauccccgcuccucuggguacaccagacuucgucgggaagauacagggagugcuuacccagacuacacgcaccgacggcagcacgcgaggccacaaggccaccgucuacauugggagugcugauuuugcccccaagcugggaagagugcaauucgagacagacacugaucaugacuuugaaaccaaccagaauacaaaauucacuccuguuggugugauccaggauggcucuaccacacacaggaacgagccacaacaguggguauugcccuccuacagcgggcggaauaccccgaacguccaccucgccccugcaguggcuccaacuuuucccggagaacagcuguuauucuuucguucgacgcugccuggcuguucugguuaucccaauauggaccucgauugccuucugccacaggaguggguucaauacuucuaucaggaggcggccccugcacaguccgacguggcuuugcuacgcuuugucaaccccgauacagggagagugcuguucgaauguaagcuccauaaaucaggcuacguaaccguggcccacacuggacagcaugaccugguuauuccaccgaauggcuauuuuagguucgauaguugggucaaccaauucuacacccuugcaccuauggggaacggaacaggucggcgacgcuga

SEQ ID NO: 21335 - RNA, 1617 nt, Artificial Sequence
  derived and/or modified sequence opt3 from VP1__Norovirus_and/or_Norovirus-like__KC456071
augaagauggccagcuccgacgcuaaucccccugauggcucugcagccaaccuggugccaaaagucaacaaugagguuauggcgcucgaaccggugguaggggcugccaucgcagcccccguggcuggacagcaaaacgucauugacccuuggauaaagaauaacuucgugcaggcaccagguggcgaguuuaccguuucacccaaaaaugccccuggggaaauccuuuggagugcuccacugggacccgauuugaacccuuacuuaagccaccuggccagaauguauaauggcuacgcggguggguucgaggugcaggucauucuagcaggaaacgccuuuacagcuggcaaggugaucuucgccgcaguaccaccgaauuuucccacugaaggccucuccccuucucagguuacgauguucccacauauuguggucgacgugaggcaacuggagcccgugcuuaucccucugccagauguccggaacaauuuuuaucacuacaaccagucgaaugaccccaccauaaaauugaucgcuaugcucuauacaccgcugcgcgccaacaacgcgggggaugacguuuucacugugucaugccgaguacugacccguccuagccccgauuuugacuucauuuuucucgugccaccuacagucgagaguagaaccaagcccuucuccgugccaguuuuaacuguggaagagaugacaaauucuagguuucccaucccucuggaaaaacuuuucaccggaccaagcuccgccuucgucgugcagccgcagaacggucgguguacgacugauggcguauugcuggggaccacacaacuaucacccguuaauauuugcacuuuucgcggagacgugacccauaucacaggcaguagaaacuacaccaugaaucucgcaagccagaacuggaauaacuaugauccuacggaggagauaccagcuccccuggguacuccugacuucgucgggaagauucagggagugcuuacacagaccacuaggacagacggcucuacccggggccacaaggccacggucuacaccggguccgcugauuuugccccaaaacugggacgcgugcaauucgaaacagacacugaucaugacuuugaggcaaaucagaacaccaaguucacacccguuggugugauccaggauggcucaacuacccaccgaaaugaaccgcaacaguggguauugccuagcuacagugggagagacacacacaacguccaucucgccccagcuguggcgcccaccuuuccuggagagcagcuguuauucuuuaggucuacuaugcccggcuguuccgguuauccaaauauggaucuggacugccuccuuccucaggaauggguucaauacuucuaucaggaggcagcccccgcucagagcgauguggcccuguugcgguuugucaacccagacacggggcgugugcuauucgaguguaaacugcacaagucgggcuacguaacaguggcacauaccggacagcacgaucucguuauuccgccuaauggcuauuuucgcuucgacucuugggucaaccaauucuacacucuggcccccauggggaacggaaccgguagaaggcgguga

SEQ ID NO: 21336 - RNA, 1617 nt, Artificial Sequence
  derived and/or modified sequence opt3 from VP1__Norovirus_and/or_Norovirus-like__KC175384
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacugggauuccuaugacccuacggaggaaacuccagcaccccuggguacaccugacuucguugggaagauccagggagugcuuacccagacuacacgcaccaauggcucaacgcgaggccacaaggcuaccgucuacacagggagcgccgauuuuaguccaaagcugggaagagugcaauucgcuacugacaccgauaacgacuuugagacaaaucagaacacuaaauucacccccgucggugugauucaggauggcucuacaaccccgaggaaugaaccucaacaguggguuuugccauccuacagcgggcggaacauccauaaugugcaccucgcccccgcaguagccccuacuuuucccggagagcagcuguuauucuuucguucgacgaugccaggcuguucugguuauccuaacauggaccuggauugccuccuuccccaggaauggguccaauacuucuaucaggaggcugcgccagcacaguccgacguggcccuguugcgcuuuguuaauccggauacagggagagugcuauucgaguguaagcugcacaaaucaggcuacgucaccguggcucauacuggacagcacgaccucguaaucccucccaacggcuauuuuagguucgauaguugggugaaccaauucuacacccuggccccaauggggaauggaacaggucggcgacgcuga

SEQ ID NO: 21337 - RNA, 1617 nt, Artificial Sequence
  derived and/or modified sequence opt3 from VP1__Norovirus_and/or_Norovirus-like__JQ613561
augaagauggccagcuccgacgcuaaccccucugauggcucaaccgcaaaucuggugccugaggucaacacagaaguuauggcccucgagccagugguaggggcggcuaucgccgcaccgguggccggacagcaaaaugucauugaccccuggauaagaaacaauuucgugcaggcuccugguggcgaauuuacuguuaguccaaggaacgcacccggggagauccuuuggagcgccccucugggaccagauuugaaucccuacuuaucccaccuggcucggauguauaacggcuacgccgguggguucgaagugcaggucauucuagcgggaaaugcauuuacggccggcaaaaucauuuucgcugccgugccuccaaacuuuccgaccgagggccucucucccucgcagguaacaauguucccucauaucauaguugacgugcgccaacuggagccaguccuuaucccccugccugaugugcgaaauaacuuuuaucacuacaaucagucaaacgacccaacuauuaaguugaucgcaaugcucuauacaccccugcgugcuaauaacgccggggaugacguguucaccgucagcugcagaguucugaccaggccgaguccugauuuugacuucauuuuucucgugcccccaacuguagaaucccggacaaaaccuuucucugugcccgucuuaaccguggaggaaaugacgaacagccgcuuuccaaucccccuggagaaacuuuucacuggaccuuccucagcguucguugugcagccacagaaugguagauguaccacagauggcgucuugcuggggacuacccaacuaaguccggugaacauaugcacauuuaggggagacguaacccauauucccggcagccggaauuacacgaugaaccucgccucucagaauuggaacuccuaugauccuacugaggaaaucccagcaccccuggguacaccugacuucguugggaagauucagggagugcuuacccagacuacacgcaccaauggcucaacgcgaggccacaaggcuaccgucuacacagggagcgccgacuuuaguccaaagcugggaagagugcaauucgcuacugauaccgacaacgauuuugagacaaaucagaacacuaaauucacccccgucggugugauccaggacggcucuacaaccccgaggaaugaaccucaacaguggguuuugccauccuacagcgggcggaacauccauaaugugcaccucgcccccgcaguagccccuacuuuucccggagagcagcuguuauucuuucguucgacgaugccaggcuguucugguuauccuaacauggaucuggacugccuccuuccccaggaauggguccaauacuucuaucaggaggcugcgccagcacaguccgaugccgcucuguugcgcuuugugaauccggacacagggagaguucuauucgaguguaagcugcacaaaucaggcuacgugaccgucgcccauacuggacagcacgaucucgugauuccucccaacggcuauuuuagguucgacaguuggguaaaccaauucuacacccuggcaccaauggggaauggaacaggucggcgacgcuga

SEQ ID NO: 21338 - RNA, 1617 nt, Artificial Sequence
  derived and/or modified sequence opt3 from VP1__Norovirus_and/or_Norovirus-like__KJ678145
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaccccacuggagaaacuuuucacgggacccucaagugccuucgucgugcagccucagaacgguagauguacuaccgauggcguauugcuggggacaacucaacuaagcccaguuaauaucugcaccuuuaggggagacgugacacauauuaccggcucucggaacuacacgaugaaucucgcaucccagaacuggucaaauuaugauccgacugaggaaauccccgcuccucuggguacaccagacuucgucgggaagauacagggagugcuuacccagacuacacgcaccgacggcagcacgcgaggccacaaggccaccgucuacacagggagugcugauuuugcccccaagcugggaagagugcaauucgagacugacaccgaucaugacuuugaaacaaaccagaauacuaaauucaccccuguuggugugauucaggauggcucuacaacccacaggaacgagccacaacaguggguauugcccuccuacagcgggcggaauacuccgaacguccaccucgccccugcaguggcuccaacguuucccggagaacagcuguuauucuuucguucgacaaugccuggcuguucugguuaucccaauauggaccuggauugccuccuuccacaggaguggguucaauacuucuaucaggaggcggccccugcacaguccgacguggcucuguugcgcuuugucaaccccgauaccgggagagugcuauucgaauguaagcugcauaaaucaggcuacguaacuguggcccacaccggacagcaugaccucguuaucccaccgaauggcuauuuuagguucgagaguugggucaaccaauucuacacacuggcaccuauggggaacggaaccggucggcgacgcuga

SEQ ID NO: 21339 - RNA, 1617 nt, Artificial Sequence
  derived and/or modified sequence opt3 from VP1__Norovirus_and/or_Norovirus-like__KF060116
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaacuccugcaccacuggguacacccgacuucguagggaagauucagggaguucuuacccagacuacaagcaccaauggcaguacgcggggccauaaggcuaccguguacacagggucugccgacuuuuccccuaagcugggacgcguccaauucgcuacugauaccaauaacgacuuugagacaaaucagaacacuaaauucaccccagugggugucauccaggauggcagcacaacuccccgaaaugaaccgcaacaguggguguugccuucguacucugggagaaacauccacaauguucaccucgccccagcaguggcccccaccuuuccuggagagcagcuguuauucuuuagguccacgaugcccggcuguucagguuauccaaacauggaccuggauugccuccuuccucaggaauggguacaauacuucuaucaggaggcugcgcccgcacagagugacgucgcccuguugcgguuugugaacccagauacagggcguguucuauucgaguguaagcugcauaaaagcggcuacgugaccgucgcucacacuggacagcaugaccucgugauuccgccuaauggcuauuuucgcuucgauuccuggguaaaccaauucuacacccuggcccccauggggaauggaacagguagaaggcgguga

SEQ ID NO: 21340 - RNA, 1617 nt, Artificial Sequence
  derived and/or modified sequence opt3 from VP1__Norovirus_and/or_Norovirus-like__KC517362
augaagauggccagcuccgacgcuaaccccucugauggcucagcagccaaucuggugccugaggucaacaaugaaguuaucgcgcucgagccagugguaggggcugccauugcagccccgguggcuggacagcaaaacgucauagaccccuggaucagaaauaacuucgugcaggcaccugguggcgaauuuaccguuaguccaaggaaugcccccggggagauucuuuggagcgcuccucugggaccagauuugaaccccuacuuaucccaccuggcccggauguauaauggcuacgcggguggguucgaagugcaggucauccuagcaggaaacgccuuuacagcuggcaaagugauuuucgccgcaguaccuccaaauuuuccgacugagggccucucucccucgcagguuacgauguucccucauaucguggucgacgugcgccaacuggagccagugcuuauaccccugccugauguccgaaacaauuuuuaucacuacaaccagucaaaugacccaaccaucaaguugauugcuaugcucuauacaccccugcgugccaacaacgcgggggaugacguuuucacugugagcugcagaguacugaccaggccgaguccugauuuugacuucaucuuucucgugcccccaacagucgaaucccggaccaaaccuuucucugugcccguuuuaacuguggaggaaaugacaaauagccgcuuuccaauuccccuggagaaacuuuucaccggaccuuccucagccuucgucgugcagccacagaacgguagauguacgacugauggcguauugcuggggaccacacaacuaaguccgguuaauaucugcacuuuuaggggagacauagcacauauuaccggcagccggaacuacacaaugaaucucgcuucucagaacuggaauaacuaugaucccaccgaggaaaucccugccccacuggguacgcccgacuucguggggaagauucagggaguccuuacucagacaacccgcacugacggcuccacacgaggccacaaggcuaccguguacacggggucagccgauuuugcaccuaagcugggaagaguccaauucgagaccgacacagaucaugacuuugaagccaaucagaacacuaaauucaccccaguggguguuauccaggauggcgggacaacucacaggaaugagccccaacaguggguguugccgagcuacaguggacggaacacccacaauguacaucucgcuccugcggucgcaccaacauuucccggcgaacagcuguuauucuuucguucuaccaugccugguuguuccggguaucccaacauggaccuggauugccuccuuccacaggagugggugcaauacuucuaucaggaggccgcuccugcccagagcgacguugcacuguugcgcuuugugaaucccgauacuggcagaguccuauucgaauguaaccugcacaagucgggauacgugacgguagcccauacaggccagcacgaccucgugaucccaccgaacggguauuuuagguucgauucuuggguuaaucaauucuacacccuggcuccuaugggaaacgguacuggccggcgacgcuga

SEQ ID NO: 21341 - RNA, 1617 nt, Artificial Sequence
  derived and/or modified sequence opt3 from VP1__Norovirus_and/or_Norovirus-like__JX644038
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaaugugugcaccuuuaggggagacguaacacauauuucuggcucccggaacuacaccaugaaucucgccucacagaacuggacgagcuaugauccgacugaggaaauccccgcaccucuggguacaccagacuucguugggaagauucagggagugcuuacccagacuacacgcaccaauggcaguacgcgaggccacaaggcuaccgucuacacagggucugccgacuuuucccccaagcugggaagagugcaauucgcuacugauaccgacaacgauuuugagacaaaucagaacacuaaauucaccccugucggugugauccaggacggcagcacaaccccaaggaaugaaccccaacaguggguuuugccgucguacucugggcggaacauccauaaugugcaccucgccccugcaguagccccaacuuuucccggagagcagcuguuauucuuucguuccacgaugccuggcuguucagguuaucccaacauggaucuggacugccuccuuccacaggaauggguccaauacuucuaucaggaggcugcgccugcacagagugauguggcccuguugcgcuuuguuaaucccgacacagggagagugcuauucgaguguaagcugcacaaaagcggcuacgucaccguggcucauacuggacagcacgaucucguaauuccaccgaacggcuauuuuagguucgacuccugggugaaccaauucuacacccuggccccuauggggaauggaacaggucggcgacgcuga

SEQ ID NO: 21342 - RNA, 1617 nt, Artificial Sequence
  derived and/or modified sequence opt3 from VP1__Norovirus_and/or_Norovirus-like__AB504313
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaacccgaggcgacggccugacgagagggcacaaggcuaccguuucuacaggauccguggauuuuacuccuaaguuggguucaguccaauucgccaccgacacagauaacgacuuugagacuggccagaauaccagguucacaccagugggggucauccaggauggaagcagugcucaucggaacgaaccccaacagugggugcucccggacuacucuggccguaccguucacaaugugcaccuggccccugcaguagccccaacuuuucccggugagcaguuacuguucuuucgcuccacgaugccuggguguagcggcuaccccaacauggaucucgacugccuucugccacaggaauggguccaacauuucuaucaggaggcugcgccugcacagucggauguggccuugcuaagauuuguugaccccgauacaggaagggugcuguucgaguguaaacuccacaagaccggcuacgucacuguggcucauaccgggcagcacgaccugguaauuccaccgaauggauauuuucgguucgacucuugggugaaccaauucuacacacuugccccuauggguaauggcgcagggcgacgcagauga

SEQ ID NO: 21343 - RNA, 1617 nt, Artificial Sequence
  derived and/or modified sequence opt3 from VP1__Norovirus_and/or_Norovirus-like__KX514361
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuaagauuuacaccaugaaucucgcauccccgaacuggaauaacuaugaccccacagaggagaucccugcuccacugggcacccccgauuucguugguaagauucaggggaugcuuacgcagacuacaaagggagaaggcucaacccgcggccaccgagccacuguguacgucgggagcgcuaauuacgccccuaaacugggaagagugcaguuugagacagacaccacggaugacuuggaugcacaucaaaacaccaaguucacaccagucggugugguucagggcggggaaagucccaaaggaucugagccgcagcaaugggugcucccuuccuauagcggcaaggacacuccaaauguacaccuggcccccgcugucgcgccuaccuuucccggugaacaguuacuguucuuuaggucgacaaucccaggguguggcggacacccuaacaugaaucucgauugccuucugccccaggagugggugcagcauuucuaccaagaggcagccccagcucagucugacguugccuugcuacgguuugugaacccggauacuucccguguccuguucgaauguaaacuccacaagucaggcuaugugaccguagcacauacagggcagcacgaccuggugaucccucccaauggauacuuucgcuucgauaguuggguuaaccaguuuuauacccuugccccaauggguaacggcacugggagaaagagguga

SEQ ID NO: 21344 - RNA, 1617 nt, Artificial Sequence
  derived and/or modified sequence opt3 from VP1__Norovirus_and/or_Norovirus-like__KX514336
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauucuggcaauuccaagauuuacaccaugaaccucgcaucaccaaauuggaacaauuaugacccgacagaggagauccccgcuccucuggguaccccagacuucguugggaagauucagggaaugcuuacgcagacuacaaagggcgaaggcagcacccgggggcaccgcgccacuguguacgucggaagugcuaacuacgcccccaaacugggucgagugcaguuugagacagauaccacggacgauuuggacgcacaucaaaauaccaaguucacaccugucggcgugguucaagggggagaaucuccaaaaggcuccgagccccagcagugggugcucccgagcuauucggguagagauacuccuaacguacaccuggccccagcugucgcgcccaccuuuccuggggaacaguuacuguucuuuaggucuacaauccccggcuguggaggccacccaaauaugaaccucgacugccuucugccucaggagugggugcagcauuucuaccaagaggcagcccccgcucaguccgauguugccuugcuacgguuugugaauccagacacuucacguguccuguucgaauguaagcuccacaaaaguggguaugugaccguagcacauacaggacagcacgaucuggugaucccgccuaacgguuacuuucgcuucgacagcuggguuaaccaguuuuauacccuugcccccaugggcaaugggacuggaagaaagagguga

SEQ ID NO: 21345 - RNA, 1617 nt, Artificial Sequence
  derived and/or modified sequence opt3 from VP1__Norovirus_and/or_Norovirus-like__KX514203
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggagcaaaccuuucuccgugcccgucuuaacugugcaggagaugacaaacucacgcuuuccagcgacccuggauaaacuuuucacgggacccaguagcacuuugguugugcagccucaaaaugguagauguaugaucgacggcguccugcuagggaccacacagcucucuccagugaacauaugcacuuucaggggagauguaacccauucccgggacucaacaauuuacaccaugaaucuggccagcccgaacuggaauaacuaugaccccacggaagagaucccugcaccacuuggcacucccgauuuuguugguaagauucagggggugcugacacagaccacuaagggagagggcaguacacgcggccaccgagcuaccgucuacguggggucugccaauuacacgccuaaguugggaaaaguccaauucgaaaccaacacaacuaaugaccucuaugcucaucagaacaccagauuuacaccaguggguguugugcagggcggggaguccgcccacaggagcgaaccccaacaguggguacugccgucguacucuggacgggauacuccuaauguccacuuagcaccagccguggcucccaccuucccuggcgagcagcugcucuuuuuccguuccacaauccccgguugugggggccauccaaacauggaccuugauugccuguugccucaggaauggguucaacacuuuuaucaggaggcggcacccgcccagucagacguggcucuacugcgcuucgucaauccagauaccaguagagugcucuuugaguguaagcugcauaaaagcggauacguaacuguggcccacacgggccagcacgaccuuguuaucccgccuaacggguauuucagguuugauuccugggucaaucaauucuacacacuggcacccaugggaaacgguaccggccggaagcgauga

SEQ ID NO: 21346 - RNA, 1617 nt, Artificial Sequence
  derived and/or modified sequence opt3 from VP1__Norovirus_and/or_Norovirus-like__KP784693
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgagggcgucuugcuggggacaacucaacuaagcccagugaauauaugcaccuuuaggggagauguaacacauauuucuggcucccggaacuacaccaugaaucucgccucacagaacuggaauagcuaugacccgacggaagagauccccgcaccucuggguacuccagauuucguugggaagauucagggagugcuuacacagaccacucgcacagacggcaguacccgaggccacaaggcuacggucuacaccgggucugccgacuuuucccccaagcugggaagagugcaauucgcuacagauacugacaacgauuuugucaccaaucagaacacaaaauucacuccuguggguguuauccaggacggcagcaccacaccaaggaaugaaccccaacaguggguguugccgucguacucugggcggaacacccauaauguacaccucgccccugcagucgccccaacuuuucccggagagcagcuguuauucuuucguuccacgaugccuggcuguucagguuaucccaacauggaucuggacugccuccuuccacaggaaugggugcaauacuucuaucaggaggcugcgccugcacagagugauguugcccuguugcgcuuugugaaucccgacacagggagaguccuauucgaguguaagcugcacaaaagcggcuacgugaccguagcucauacuggacagcacgaucucgugaucccaccgaacggcuauuuuagguucgacuccuggguuaaccaauucuacacccuggccccuauggggaauggagcaggucggcgacgcuga

SEQ ID NO: 21347 - RNA, 1617 nt, Artificial Sequence
  derived and/or modified sequence opt3 from VP1__Norovirus_and/or_Norovirus-like__AB933734
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucugagacuaaaccauucuuuuucccuguguuaacagucgaagagaugaccaauagccgguuccccaucccacuggagaaacuuuuuacgggacccuccucagcguucgugguucagccucagaacggucgcuguacuaccgauggcguguugcuggggacaacucaacuaaguccagucaauauaugcaccuuuagaggagacgugacacauauuccgggcagcaggaacuacaccaugaaucucgccucucagaacuggaacuccuaugaucccacggaagagaucccugcaccacuggguacucccgacuucguagggaagauucagggaguucuuacacagaccacucggacaaauggcucaacccgcggccacaaggcuacgguguacaccgggagcgccgacuuuaguccuaagcugggacgaguccaauucgcuacagauacugacaaugauuuugaaaccaaccagaauacaaaauucacuccagugggugucauccaggacggcucuaccacacccagaaacgagccgcaacaguggguguugccuuccuacagcgggaggaauauccauaacguucaccucgccccagcaguggcccccaccuuuccuggagaacagcuguuauucuuucggucgacuaugcccggcuguucugguuauccaaauauggaucuggacugccuccuuccucaggaguggguacaauacuucuaucaggaggcugcgcccgcacaguccgaugucgcccuguugcguuuugugaacccagacacggggcgcguucuauucgaauguaagcugcacaaaucaggcuacgugacagucgcucauaccggacagcacgaucucgugauuccgccuaacggcuauuucagauuugacaguuggguaaaucaauucuacacucuggcccccauggggaacggaaccgguaggcggcgauga

SEQ ID NO: 21348 - RNA, 1617 nt, Artificial Sequence
  derived and/or modified sequence opt3 from VP1__Norovirus_and/or_Norovirus-like__KF060041
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucggagugcaggucauucuagcaggcaacgccuuuacagcuggcaaagugaucuucgccgcaguaccuccaaauuuuccgacugaagggcucucucccucgcagguuacgauguucccucauauuguggucaacgugcgccaacuggagccagugcuuaucccccugccugacguccgaaauaacuuuuaucacuacaaucagucaaacgauccaaccauaaaguugaucgcuaugcucuauacaccccugcgugccaacaaugcgggagacgauguuuucacugugagcugcagaguacugaccaggccgaguccugacuuugauuucauuuuucucgugcccccaacagucgagucccggaccaaaccuuucucugugcccguuuuaacuguggaagagaugacaaacagccgcuuuccaaucccccuggaaaaacuuuucaccgguccuuccucagccuucgucgugcagccacagaauggcagauguacgacugacgggguauugcugggaaccacacaacuaaguccgguuaacauuugcacuuuuaggggcgaugugacccauaucacagguagccggaauuacaccaugaaccucgcaucucagaauuggaacaauuaugaccccacggaggagacuccugcuccacuggggacacccgauuucgucggaaagauacagggcgugcuuacccagacuacacgcaccgacggcuccacgcgagggcacaaggccaccgucuacacaggaucagcugacuuugccccuaagcuggguagagugcaauucgaaacugauaccgaccaugauuuugaggcaaaccagaauacaaaauucacuccaguuggcgugauucaggacgggagcaccacacacaggaacgaaccccaacaguggguauugccgaguuacucuggacggaauacccacaacguccaucucgccccugcuguggcgccaacuuuucccggcgagcagcuguuauucuuucguuccacgaugccugguuguagcggguaucccaauauggaucuggacugccuccuuccacaggaauggguucaauacuucuaucaggaggcagccccugcucagucggauguggcccuguugcgcuuugucaaccccgacacaggcagagugcuauucgaguguaagcugcacaaaucuggauacguaaccguggcacucacuggccagcaugaucugguuaucccaccgaacggguauuuuagguucgacuccugggucaaucaauucuacacccuugccccuaugggaaacgguacaggccggcgacgcuga

SEQ ID NO: 21349 - RNA, 1617 nt, Artificial Sequence
  derived and/or modified sequence opt3 from VP1__Norovirus_and/or_Norovirus-like__JX989074
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaacuccugcaccacuggguacacccgacuucguugggaagauccagggagugcuuacccagacuacacgcaccaauggcagcacgcgaggccacaaggcuaccgucuacacagggagugccgacuuuucuccuaagcugggaagagugcaauucgcuacugauaccgacaaugauuuugagacaaaccagaauacuaaauucaccccagucggugugauucaggacggcuccacaacccccaggaacgaaccgcaacaguggguuuugccuagcuacucggggcggaauauccauaacgugcaccucgccccagcaguagcccccacuuuuccuggagagcagcuguuauucuuucguucuacgaugcccggcuguuccgguuauccaaauauggaucuggacugccuccuuccucaggaauggguccaauacuucuaucaggaggcugcgcccgcacagucagauguggcccuguugcgcuuuguuaacccagacacagggagagugcuauucgaguguaagcugcacaaaaguggcuacgucaccguggcucauacuggacagcacgaucucguaaucccgccuaacggcuauuuuagguucgacagcugggugaaucaauucuacacccuggcccccauggggaacggaacaggucggcgacgcuga

SEQ ID NO: 21350 - RNA, 1617 nt, Artificial Sequence
  derived and/or modified sequence opt3 from VP1__Norovirus_and/or_Norovirus-like__JN400624
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgauagauguacuaccgacggugucuugcugggcacaacucaacuaaguccggugaauauaugcaccuuuaggggagauguaacacauauucccgggagccggaacuacaccaugaaucucgccucucagaacuggaacuccuaugacccuacggaggaaaucccagcaccccugggcacuccugacuucguugguaagauucagggggugcuuacacagaccacucgcacaaauggaucaacccgaggccacaaggcuacggucuacaccggcagcgccgauuuuaguccaaagcuggggagagugcaauucgcuacagacacugauaaugacuuugagaccaaccagaauacaaaauucacucccgucggagugauccaggaugguucuaccacaccgaggaacgaaccucaacaguggguuuugccauccuacagcggccggaauauccauucggugcaccucgcccccgcaguagccccuaccuuucccggggagcagcuguuauucuuucguucuacuaugccaggauguuccggcuauccuaacauggaccuggauugccuccuuccccaggaauggguccaauacuucuaucaggaggcugcgccagcacagucagacguggcccuguugcgcuuuguuaauccggauacggguagagugcuauucgaguguaagcugcacaaaaguggguacgucacaguggcucauaccggccagcacgaccucguaauuccucccaacggauauuuuagguucgauagcugggugaaccaauucuacacucuggccccaaugggcaaugggaccggacggcgacgcuga

SEQ ID NO: 21351 - RNA, 1617 nt, Artificial Sequence
  derived and/or modified sequence opt3 from VP1__Norovirus_and/or_Norovirus-like__EU876894
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccagaauaaggaauaacuucgugcaggcuccugguggcgaauuuacaguuaguccacggaaugcacccggggagauccuuuggagcgccccucugggaccagauuugaaccccuacuuaucccaccuggcucgcauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgacaacuggagccaguccuuaucccccugccugaugugcguaacaauuuuuaucacuacaaccagagcaaugacccaacaauuaaguugaucgcaaugcucuauacuccccugagagcuaacaacgccggcgaugacguguucaccgucaguugcuggguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguagguaagauccaggggguucuuacccaaacuacacgguccgacggaucaacccgcggccacaaggccacggugagcaccggcaguguccauuuuacaccuaagcuggggcgaauccaguucucuacugauaccuccaacgacuuugaaacaggacagaauacuagauucaccccagugggugucgugcaagauggcagcacaacccaccagaacgagccccagcaguggguuuugccgaauuacucggggagggacucucacaacgugcaucucgcuccugccguagcaccauccuuucccggagaacaacuguuauucuuucggucaacuaugccuggcuguagugguuaccccaauaugaaccuggauugccuccuuccacaggaguggguccagcacuucuaucaggaggccgcuccugcgcaaagcgacguggcacuguugcguuuuguuaaucccgauacggggcgcgugcuauucgaauguaaacugcauaaguccggcuacgucacaguggcccacaccggacagcacgaccucguaauuccaccgaacggcuauuuuagauucgauucuugggugaaccaguucuacacucuggcuccuauggggaauggaaccgguaggcggcgauga

SEQ ID NO: 21352 - RNA, 1617 nt, Artificial Sequence
  derived and/or modified sequence opt3 from VP1__Norovirus_and/or_Norovirus-like__KX514173
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccagugaaucuggaaagacuuuucacuggucccucaagugccaacguugugcagccucagaaugggagguguaccauagauggcgaguugcugggaacaacucaacuaagcucugucaacauuugcaccuuccggggcgacgugacacauaucgguaccacgcgccacuggacuaugaaucucgcguccccaaacuggaauaacuacgauccgacagaggaaacccccgccccucuggggacuccagacuuuguaggaaagauucagggcaugcuuacacagaccacgaaaggcgaggggucaacccgaggacauagagcaacaguuuauguggguagcgcuaauuacgcccccaagcugggcaggguccaguucgaaacugacaccacaaacgauuuggacgcucaccaaaauacuaaguuuaccccugugggggucgugcagggaggcgagaguccaaaagguucugaaccccagcaauggguucucccguccuacagcgggcgggauacaccuaacgugcaccuggccccagcaguagcccccaccuucccuggcgagcaguuacuguuuuuccguucgacuauccccggauguggcgggcauccaaauaugaaccucgacugccuucugccucaggaguggguccagcacuuuuaucaagaagcugcgcccgcacagucugauguggccuugcuacgcuucguuaauccagacacguccagagugcuguuugaguguaagcuccauaaaucaggauacgucacaguggcucacaccggucaguaugaucugguacuuccgaguaacggcuacuucagguuugacagcugggugaaccaguucuauacucuggccccuauggggaauggaaccggccggcgacgcuga

SEQ ID NO: 21353 - RNA, 1617 nt, Artificial Sequence
  derived and/or modified sequence opt3 from VP1__Norovirus_and/or_Norovirus-like__KX353989
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccaugguuccucauaucauaguggacguccgccaacuggagccagugcuuaucccccugccugaugugcgaaacaauuucuaucacuacaaccagucaaaugacagcacaauuaaguugaucgcaaugcucuauacuccacugcgugcuaacaacgccggggaugacgucuuuaccguuaguugcagagugcugacaaggcccuccccggauuucgacuuuauuuuccucguaccucccaccguggaaucucggacuaaaccauuuagcgucccuaucuuaacaguggaggaaaugaccaauucccgcuuccccauaccacuggagaaacuuuuuacgggacccucaagugcguucguugugcagccucagaacgguagauguacuaccgauggcgucuugcuggggacaacucaacuaagcccagugaauauuugcaccuucaggggagacguaacacauaucccgggcucucacaacuacaccaugaaucucgccucccagaacuggaacucauaugaucccacggaggaaauuccugcaccacuggguacucccgacuuuguugggaagauccagggagugcuuacacagaccacuagcacaaauggcaguacccggggccauaaggcuacggucuacaccgggucugccgacuucuccccuaagcugggacgcgugcaauuugcuacagauacuaauaacgacuucgagaccaaucagaacacaaaauuuacuccagucggugugauccaggauggcagcaccacaccccgaaaugaaccgcaacaguggguuuugccuucguacucugggagaaacauucacaaugugcaccucgccccagcaguagcccccaccuucccuggagagcagcuguuauuuuucagguccacuaugcccggcuguucagguuauccaaacauggaccuggauugccuccuuccucaggaauggguccaauacuuuuaucaggaggcugcgcccgcacagagugacguggcccuguugcgguucguuaacccagauacggggcgugugcuauuugaguguaagcugcauaaaagcggcuacgucacaguggcucacaccggacagcaugaccucguaauaccgccuaauggcuauuuccgcuuugauuccugggugaaccaauucuacacucuggcccccauggggaauggaaccgguagaaggcgguga

SEQ ID NO: 21354 - RNA, 1617 nt, Artificial Sequence
  derived and/or modified sequence opt3 from VP1__Norovirus_and/or_Norovirus-like__KX353962
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauccccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccaggacacaaaauucacucccgucggugugauccaggauggcucuaccacaccgaggaaugaaccucaacaguggguuuugccauccuacagcgggcggaacauccauaaugugcaccucgcccccgcaguagccccuaccuuucccggagagcagcuguuauucuuucguucgacuaugccaggcuguucugguuauccuaacauggaccuggauugccuccuuccccaggaauggguccaauacuucuaucaggaggcugcgccagcacaguccgacguggcccuguugcgcuuuguuaauccggauacggggagagugcuauucgaguguaagcugcacaaaucaggcuacgucacaguggcucauaccggacagcacgaccucguaauuccucccaacggcuauuuuagguucgauaguugggugaaccaauucuacacucuggccccaauggggaauggaaccggucggcgacgcuga

SEQ ID NO: 21355 - RNA, 1617 nt, Artificial Sequence
  derived and/or modified sequence opt3 from VP1__Norovirus_and/or_Norovirus-like__AB972515
augaagauggccagcuccgacgcuaaccccucugauggcucaaccgcaaaucuggugccugaggucaacaaugaaguuauggcccucgagccagugaucggggcggcuauugccgcaccgguagccggacagcaaaacgugauagaccccuggaucagaaauaacuucguccaggcuccugguggcgaauuuacagugaguccaaggaaugcacccggggagauucuuuggagcgccccucugggaccagauuugaaccccuacuuaucccaccugucucggauguauaauggcuacgcugguggguucgaaguucaggugauccuagccggaaacgcguuuacugcaggcaaaauuaucuucgccgcugucccuccaaauuuuccgacggagggccucucgcccucacaggugaccauguucccucauaugauaguagacguucgccaacuggagccagugcuuaucccccugccugauguccgaaacaauuuuuaucacuacaaccagagcaaugacaguacaauuaaguugaucgccaugcucuauacuccacugcgugcaaacaacgcuggggaugacguguucaccguguccugcagaguccugacaaggcccucuccggauuuugacuucauuuuucucguuccucccaccguggaaagccggacuaaaccauucuccguaccuguguuaacagucgaggaaaugaccaauucacgcuuucccaucccacuggagaaacuuuucacgggacccaguagcgccuucgugguucagccucagaacgguagauguacuaccgauggcguguugcuggggacaacucaacuaucuccagucaauauaugcaccuuuaggggagacgugacacauauuccgggcucccggaacuacaccaugaaucucgcgucacagaacuggaauagcuaugaucccacggaggaaaucccugccccacuggguacucccgacuucguagggaagauucagggaguucuuacacagaccacucgcacaaacggcaguacccgaggccacaaggcaacgguguacaccgggucugcugacuuuuccccuaagcugggaagaguccaauucgccacagauacugacaaugauuuugagaccaaccagaauacaaaauucacuccagugggugucauccaggacggcagcaccacacccaggaacgaaccgcaacaguggguguugccuucguacucugggcggaauauccauaacguucaccucgcuccagccguggcacccaccuuuccuggagagcagcuguuauucuuucguuccacuaugcccggcuguucagguuauccaaauauggaucuggacugccuccuuccucaggaauggguacaauacuucuaucaggaggccgcucccgcgcagagugaugucgcacuguugcgcuuugugaacccagacacggggagaguucuauucgaguguaagcugcacaaaagcggcuacgugacagucgcccauaccggacagcacgaucucgugauuccgccuaacggcuauuuuagguucgacuccuggguaaaucaauucuacacucuggcucccauggggaacggaaccggucggcgacgcuga

SEQ ID NO: 21356 - RNA, 1617 nt, Artificial Sequence
  derived and/or modified sequence opt3 from VP1__Norovirus_and/or_Norovirus-like__KT033904
augaagauggccagcaacgacgcuaaucccuccgauggcucugcagccaaccuggugccuaaagucaauaacgagguuauggcgcucgaaccagugguaggggcugccaucgcagccccgguggcuggacagcaaaaugucauugaccccuggauaaagaacaauuucgugcaggcaccugguggcaaauuuaccguuucaccaaagaacgcccccggggagauccuuuggagugcuccucugggaccagauuugaaucccuacuuaagccaccuggccagaauguauaaaggccaugcggguggguucgaagugcaggucauucuagcaggaaacgccuuuacagcuggcaagaucauuuucgccgcagugccuccaaauuuuccgacugagggccucucccccucucagguaacgauguucccucacaucauaguugacgugaggcaacuggaaccaguccuuaucccccugccugaugugcggaacaauuuuuaccauuauaaccagucgaaugacucaaccauuaaguugaucgcuaugcucuacacaccacugcgcgccaacaacgcgggggaggauguguucacugucagcugccgaguucugacccgucccaguccggacuuugauuucauuuuucucgugccucccacaguagaguccagaaccaaaccauucacugugccuaucuuaacagucgaagagaugaccaauucuagguuucccauaccacuggaaaaacuuuucacgggacccagcuccgccuucgugguucagccucagaacggucgguguacuaccgacggcguguugcuggggacaacucaacuaucaccagucaauauuugcaccuuucgcggagaugugacacacaucgcaggcaguagaaacuauaccaugaaucucgcuagccugaacuggaauaacuacgacccgacggaggagauucccgccccucuugguacuccagauuucguagggaagauccagggaguucugacacagaccacuaagggcgacggcucuacaagggggcauaaagcuaccguguauacgggauccgcccccuuuaccccuaaguuggguucaguccaguucagcacagacacugaaaaugauuuugagacccaccaaaacacaaaguucacuccagugggcgucauccaggacgggggaaccacacaccggaaugaaccccagcaaugggugcucccgaguuacucuggccgcaacguuccuaaugugcaucuggcaccagccguagcucccaccuuuccuggugagcaguuacuguucuuucgauccacuaugcccggguguagcggcuacccaaacauggaucucgacugccuucugccucaggaauggguccagcacuucuaucaagaggcggcacccgcccagucggauguggcuuugcuaagauuuguuaauccagacacgggaagggugcuguucgaguguaaacuccauaagucuggcuacgucacaguggcccacaccgggcagcacgaucugguaauuccgccuaacggauauuuucgguucgacuccugggugaaccaguucuacacucuugcacccauggguaauggcaccgggcgucgcagauga

SEQ ID NO: 21357 - RNA, 1617 nt, Artificial Sequence
  derived and/or modified sequence opt3 from VP1__Norovirus_and/or_Norovirus-like__KM982942
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaucgggagcgcugauuuugccccuaagcugggacgagugcaauucgagaccgacacaaaccacgauuuugaagcaaaucagaacacuaaauucaccccaguuggugugauucaggacggcgggacaacucacagaaaugagccccaacaguggguauugccgaguuacucuggaaggaacaccccuaauguccaucucgccccagcuguggcgcccacauuuccuggcgaacagcuguuauucuuucgguccaccaugcccgguuguagcggguauccaaacauggaucuggacugccuccuuccucaggaguggguucaauacuucuaucaggaggcagcccccgcucagucggauguggcccuguugcguuuugucaauccagacacuggccgcgugcuauucgaauguaagcugcacaaaucuggauacguaacgguggcacauacaggccagcacgaucucguuaucccgccuaacggguauuuuagauucgacuccagggucaaccaauucuacacccuggcccccaugggaaaugguacuggccggcgacgcuga

SEQ ID NO: 21358 - RNA, 1617 nt, Artificial Sequence
  derived and/or modified sequence opt3 from VP1__Norovirus_and/or_Norovirus-like__KJ685417
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaauucauaucucuggcucccggaacuacacaaugaaucucgccucacagaacuggaauagcuaugauccgaccgaggaaauucccgcaccucuggguacgccagacuucguugggaagauccagggagugcuuacucagacaacccgcacugacggcaguacacgaggccacaaggcuaccgucuacacggggucugccgauuuuucccccaagcugggaagagugcaauucgcuaccgacacagauaacgacuuugucacuaaucagaacaccaaauucacaccuguggguguuauccaggauggcagcacuaccccaaggaaugagccccaacaguggguguugccgucguacucugggcggaacacacauaauguacaccucgccccugcagucgccccaaccuuucccggagaacagcuguuauucuuucguuccacuaugccuggcuguucagguuaucccaacauggaccuggauugccuccuuccacaggagugggugcaauacuucuaucaggaagcugcgccugcacagagugacguugcccuguugcgcuuugugaaucccgauacggggagaguccuauucgaguguaagcugcacaaaagcggcuacgugacaguagcucauaccggacagcacgaccucgugauuccaccgaacggcuauuuuagguucgauuccuggguuaaccaauucuacacucuggccccuauggggaauggaaccggucggcgacgcuga

SEQ ID NO: 21359 - RNA, 1617 nt, Artificial Sequence
  derived and/or modified sequence opt3 from VP1__Norovirus_and/or_Norovirus-like__KC907392
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcagcccaauaccccuggagaaacuuuuuacuggaccuuccucagcguucgugguucagccacagaacgguagauguaccacagauggcguguugcuggggacuacccaacuaaguccggucaauauuugcacauucaggggagacguggcccauaucgcaggcacccagaacuacacgaugaaucucgcuagccagaacuggaauaacuaugaucccacugaggaaauuccugccccacuggguacacccaauuuuguagggaagauccagggaguucuuacccaaacuacaaagcgggacggcucuacccgcggccgaaaggcuacgguguccaccgggucaguccacuucacaccuaaacugggaagcgugcaguuuaguacugacaccucuaacgauuucgagacaggucagaauacuagauuuaccccagucggcgugguucaagacggguccacaacccauaggaacgaaccccagcaguggguguugccggauuacagcggacgggacucgcacaauguacaccucgccccugcagucgccccaacuuuccccggcgagcagcuguuauuuuuccguucuuccaugccugguuguucaggguaccccaacauggaucuggacugccuccuuccacaagaaugggugcagcauuuuuaucaggagagugcuccugcgcagagcgauguugcacuguugcgcuucgugaaucccgacacgggcagaguccuauuugaguguaagcugcacaaauccggauacgugacaguagcccauaccggccaacacgaucucgugaucccaccgaacggguauucuagguucgacagcuggguuaaccaguuuuacacucuggcuccuaugggaaauggugccggccggcgacgcuga

SEQ ID NO: 21360 - RNA, 1617 nt, Artificial Sequence
  derived and/or modified sequence opt3 from VP1__Norovirus_and/or_Norovirus-like__KC517377
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuaugcgccccugcgugccaacaacgccggggaugacguuuucacagugagcugcagaguacugacuaggccgaguccugauuuugacuucauuuuucucgugcccccaaccgucgaaucccggacaaaaccuuucucugugcccguuuuaaccguggaggaaaugacuaauagccgcuuuccaaucccccuggagaaacuuuucacaggaccuuccucagcauucgucgugcagccacagaacgguagauguaccacggauggcguauugcuggggacuacccaacuaaguccgguuaauauuugcacauuuaggggagacgugacucauaucaccggcagccggaacuacacaaugaaucucgcuucucagaacuggaauaacuaugaucccaccgaggaaauaccugccccacuggguacgcccgacuucgucgggaagauucagggagugcuuacucagacaacccgcacugacggcuccacacgaggccacaaggcuaccgucuacacggggucagccgauuuugcaccuaagcugggaagagugcaauucgagaccgacacagaucaugacuuugaagccaaucagaacacuaaauucaccccaguuggugugauccaggauggcgggacaacucacaggaaugagccccaacaguggguauugccgagcuacaguggacggaacacccacaauguccaucucgcuccugcgguggcaccaacauuucccggcgaacagcuguuauucuuucguucuaccaugccugguuguuccggguaucccaacauggaccuggauugccuccuuccacaggaguggguucaauacuucuaucaggaggccgcuccugcccagagcgacguggcacuguugcgcuuugucaaucccaacacuggcagagugcuauucgaauguaagcugcacaaaucgggauacguaacgguggcccauacaggccagcacgaucucguuauuccaccgaacgacuauuuuagguucgauucuugggucaaucaauucuacacccuggcuccuauggggaacggaacuggucggcgacgcuga

SEQ ID NO: 21361 - RNA, 1617 nt, Artificial Sequence
  derived and/or modified sequence opt3 from VP1__Norovirus_and/or_Norovirus-like__KC517368
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgcacaggccccugguggcgaauuuaccgugucaccaaggaacgcucccggggagauccuuuggagugccccucugggaccagauuugaaucccuacuuaagccaccuggcgcggauguauaacggcuacgccgguggguucgaaguucaggugauucuagcagagaaugcuuuuacagccggaaaaaucauuuucgcagcugucccuccaaacuuuccgacugagggccucucccccucucgcgugacgauguucccucauaucauaguagacguucgacagcuggaaccagugcuuaucccccugccugauguccguaauaacuuuuaucacuacaaucaaucgaacgacucaaccauuaaguugaucgccaugcucuauacaccacugagagcgaacaaugccggcgaggauguguucacugugagcugcaggguccugacccggcccaguccggacuuugauuucauuuuucucguuccucccacaguggaaucccgcaccaaaccauucacuguaccuaucuuaacaguggaggagaccacgaacucuagauuucccauaccacuggaaaaacuuuucacugggcccagcuccgcauucgucgugcagccucagaauggaagguguaccacagacgguguuuugcugggcacuacccagcuaucaccagugaacauuugcacauuucgcggggaugucacccauaucgcuggaagucggaauuacacgaugaaccucgccagccugaauuggaacaauuaugugccgacugaggaaauucccgcuccucuuggcacaccagacuucguagguaagguucaagggaugcugacccagacuacaaagggagauggcucuacccgaggccacaaggccacgguguacaccggguccgcacccuuuacaccuaaauugggaucaguccaguucgagacugacaccgaaaacgacuuugagacacaucagaauacuaaguucaccccagugggugucauccaagauggcgggacaacccacagaaacgagccccagcagugggugcucccgagcuacaguggaaggaauguuccuaacgugcaccuggccccagcuguagcgcccacuuuuccuggcgaacaauuacuguucuuucggucuacgaugcccgguuguuccggguauccaaauauggaccucgauugccuucugccucaggaguggguccagcauuucuaccaggaagcagcccccgcucaaagcgacguggccuugcuacguuuuguuaacccagauacaggccgcgugcuguucgaguguaaacuccacaagucgggauaugucaccguggcacauacuggccagcacgaccugguaaucccgccuaacggguacuuuagauucgauucuugggugaaucaguucuauacccuugcccccaugggaaacgguacaggcaggcggcgauga

SEQ ID NO: 21362 - RNA, 1617 nt, Artificial Sequence
  derived and/or modified sequence opt3 from VP1__Norovirus_and/or_Norovirus-like__AB541310
augaagaugagaagcuccgacgccaaccccucugauggcucaaccgcuaaucuggugccugaggucaacaaugaaguuauggcacucgagccagugguaggggccgcgaucgcugccccgguggcaggacagcaaaacgucaucgaccccuggauaaggaauaacuucgugcaggccccugguggcgaauuuacaguuaguccacggaaugcucccggggagauccuuuggagcgcaccucugggaccagauuugaaccccuacuuaucccaccuggcccgcauguauaauggcuacgcugguggguucgaagugcaggucauucuagccggaaacgcguuuacugcaggcaaaaucauuuucgccgcugugccuccaaauuuuccgacggagggccucucucccucgcagguaaccauguucccucauaucauaguugacgugcgacaacuggagccaguccuuaucccccugccugaugugcguaacaauuuuuaucacuacaaccagucaaaugacccaacaauuaaguugaucgccaugcucuauacuccccugagagcaaacaacgcuggggaugacguguucaccggaagcugcaggguccugacacggccgaguccugauuuugacuucauuuuucucguucccccaaccguggaaucccgcacuaaaccuuucucuguauccuuuuucacaggugaggaaaugaccaauuccagauuccccaucccauuagagaagcuguuuacgggccccucaagugccuucgugguccagccucagaacgggagguguacuaccgauggagugcuuuugggcacaacucaacugagcccaguuaauauaugcaccuuucggggugacgugacacauauuaccgggucucgcaacuacacgaugaaucuagcgacucagaacuggaauagcuaugauccgacagaggaaauccccgccccucucggaaccccagacuucgucggcaaaauucagggcgugcugacucagacaacccgagcagacgggucaacgagaggacacaaggcuaccguauacacagguagcgccgauuuugcucccaaacuuggcaggguucaauucgccacugacaccgauaacgacuuugaugcaaaucagaacacaaaguucacuccugugggggucauccaggacggagauaccgcccaucggaaugagccacaacagugggugcugcccaguuacucuggccguaacucccacaauguccacuuggcuccggcgguggcaccuacauuuccaggugaacagcuccuguucuuucgcagcaccaugcccggguguucgggcuauccuaacauggacuuagauugccugcucccccaggaguggguucaauacuucuaucaggaagccgcuccagcccagucugacguggcacuucugagauuuguaaauccugauacuggaagggucuuguucgaguguaagcuacauaaauccggcuacgugacgguugcccacacagggcagcaugaccuggugauucccccaaacggauauuuccgguuugacucaugggucaaccaauucuacacccucgcuccgauggguaauggcacugggcgacgcagauga

SEQ ID NO: 21363 - RNA, 1617 nt, Artificial Sequence
  derived and/or modified sequence opt3 from VP1__Norovirus_and/or_Norovirus-like__EF535854
augaagauggccaccaacgacgcuagccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaaguggaggucauucuagcgggaaacgcauuuacggccggcaaaaucauuuucgcugccgugccuccaaauuuuccgaccgagggccucucccccucucagguaacaauguucccucauaucauaguugacgugcgccagcuggaaccaguccuuaucccccugccugaugugcgaaacaauuuuuaucacuacaaccaaucgaaugacucaacuauuaaguugaucgcaaugcucuauaccccacugcgugcuaacaacgccggggaugacguguucacagucagcugcagaguucugaccaggcccaguccggauuuugacuucauuuuucucgugccucccacuguagagucccggacaaaaccauucaccgugccuaucuuaacggucgaagagaugacuaauucucgcuuucccauaccacuggagaaacuuuucaccggacccagcuccgcguuggugguucagccucagaacgguagauguacaacugauggcgugcugcuagggaccacacagcucucaccagucaauauuugcaccuucaggggagacgugacgcauaucaguggcacucggacauaccgcaugaaccuggccagccaaaauuggaacaauuaugauccgaccgaagagauucccgcaccucuugguacuccagacuuuguagggaagauccagggaaugcugacacagaccacgaagggcgacggcucuacccgagggcacaaggcuacaguuuccacuggaucaguggauuucacccccaaauuggguagcguccaguuugccacagacacugauaacgacuucgaaaccggccaaaauacaagauuuaccccugugggggucauccaggauggaaguucugcucauaggaacgagccacagcaaugggugcuccccgacuacuccggccggacuguucacaaugugcaccuggccccggcaguagccccuacguucccaggugaacaguuacccuuuuuccguagcacaaugccuggguguucgggcuaccccaacauggaucuggacugccuccuuccacaggaguggguccagcauuuuuaucaagaggcugcgccuucucaguccgauguggcacuguugcgcuucguuaaucccgacaccggaagagugcuauuugaauguaagcugcacaaagccggcuacgucacuguggcucauaccgggcagcacgaucucguaauuccaccgaacggauauuucagguuugacucaugggugaaucagaguuacacacuggccccuauggguaacggcgcagggcggcgacgcuga

SEQ ID NO: 21364 - RNA, 1617 nt, Artificial Sequence
  derived and/or modified sequence opt3 from VP1__Norovirus_and/or_Norovirus-like__KX514368
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccaggcaauucuaagauuuacaccaugaaccucgcauccccgaauuggaacaauuaugaccccacagaggagaucccugcuccacuggguacccccgacuucguugggaagauucagggaaugcuuacgcagacuacaaagggcgaaggcucaacccgggggcaccgcgccacuguguacgucggaagcgcuaacuacgccccuaaacugggucgagugcaguuugagacagauaccacggacgauuuggacgcacaucaaaauaccaaguucacaccagucggcgugguucaagggggagaaagucccaaaggcucugagccgcagcagugggugcucccuuccuauagcgguagagauacuccaaacguacaccuggcccccgcugucgcgccuaccuuucccggggaacaguuacuguucuuuaggucgacaaucccaggcuguggaggccacccuaauaugaaccucgacugccuucugccccaggagugggugcagcauuucuaccaagaggcagccccagcucagucugauguugccuugcuacgguuugugaauccggacacuucccguguccuguucgaauguaagcuccacaaaucaggguaugugaccguagcacauacaggacagcacgaucuggugaucccucccaacgguuacuuucgcuucgacaguuggguuaaccaguuuuauacccuugccccaaugggcaaugggacuggaagaaagagguga

SEQ ID NO: 21365 - RNA, 1617 nt, Artificial Sequence
  derived and/or modified sequence opt3 from VP1__Norovirus_and/or_Norovirus-like__KX514351
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccaggcuugaaucccuacuuaagccaccuggcucggauguauaacgguuacgccgggggauucgaagugcaggucauucuagcgggcaaugcauuuacugccggcaaaaucauuuucgcugccgugccuccaaacuuuccgacggaggggcucaaucccucccagguaaccauguucccucauaucauaguugaugugcgccaacuggagccaguccuuaucccccugccugacgugcgaaacaauuuuuaucacuacaaccagucuaacgauucgacaauuaaguugaucgcaaugcucuauacuccacugcgugcuaauaacgccggagacgauguguucaccgucucaugcagaguucugacaaggcccagcccggacuuugauuucauuuuucucgugccucccaccguagaaagucgguccaaaccauucucugugccugucuuaacugugcaggagaugacaaauagccgcuuucccgcgacccuggacaaacuuuucacggguccauccucaaacuugguugugcagccccaaaauggcagauguaugaucgaugggguccugcuaggaacuacccagcucaguccugugaacauaugcacauucaggggcgacguaacucaucugcgggauagcaccauuuacacaaugaaucuugccucuccaaacuggaauaacuaugacccgaccgaagagauccccgcaccucuggguacgccagacuuuguugggaagauucagggaguguugacucagacaaccaagggcgagggcuccacucgcgggcaccgagcuacagucuacgugggaucagccaauuacacccccaagcucgguaaaguccaauucgaaacgaacaccacaaaugaucuguaugcucaucagaacacuaaguuuaccccugugggcguugugcaagggggagagagcgcccacagaagugaaccacagcaguggguauuacccggcuucucugguagggacacaccgaauguccaccuggccccugcaguggcuccaacuuuucccggggagcagcuccuuuucuuucgguccaccaucccuggcuguggaggccaucccaacauggaucuggacugcuugcuaccacaggaauggguucaacacuucuaccaggaggcggccccugcacagagcgauguggcucugcuccguuuugucaaccccgacacaucgcgcgugcuguucgaguguaaacuucauaagucuggguauguaaccguggcccacacuggacagcacgaucugguuaucccaccgaaugguuacuuuagauucgacuccugggucaaccaauuuuauacguuggcaccuaugggcaaugggacaggaaggaaacgguga

SEQ ID NO: 21366 - RNA, 1617 nt, Artificial Sequence
  derived and/or modified sequence opt3 from VP1__Norovirus_and/or_Norovirus-like__KC517372
augaagauggccagcaacgacgcuaaucccuccgauggcucugcagugaaccuggucccugagguuaauaacgaagugauggcccucgagccaguagugggggcggcuaucgccgcaccggucgccggacagcaaaaugugauugaccccuggauaagaaacaauuucguucaggcuccugguggcgaauuuaccgugucaccaaggaacgcacccggggagauccuuuggagugccccucugggaccagauuugaaucccuacuuaagccaccuggcucggauguauaacggcuacgccgguggguucgaaguccaggugauucuagcgggaaaugcauuuacagccggcaaaaucauuuucgcugccguaccuccaaacuuuccgacugagggccucucccccucucagguuacgauguucccucauaucauaguggacgcacgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcuccgccuucgugguucagccucagaaugguagauguacuaccgacggcguguugcuggggacaacucaacuaucaccagucaacauuugcaccuuuaggggagauguggcacauaucgcuggcagucggaauuacacaaugaaccucgccagccugaauuggaacaauuaugacccgaccgaagagauucccgcuccucuugguacgccagauuucguagggaaaauccagggaaugcugacucagacaaccaagggcgacggcucuacucgcgggcacaaggccacaguuuacaccggauccgcacccuuuacgccuaaauuggguucagugcaguucgaaaccgacacagagaacgauuuugaaacucaucaaaauaccaaguucacaccagucggcgugauccaggacgggggaacuacccaccgaaacgagccccagcaauggguccucccgagcuacaguggcagaaaugugccuaacguucaccuggccccagcuguggcgcccacauuuccuggugagcaguuacuucucuucaggucuaccaugcccggguguuccggcuauccaaauauggaucuugacugccuguugccucaggaauggguacagcauuuuuaccaagaggcagcccccgcucagagcgaugucgcccuacugcgguucgugaacccagacacuggacguguucucuuugaauguaaacugcacaagucgggcuaugugacggucgcacauacagggcagcacgaucuugugauuccgccuucuggauacuuccgcuuugacuccuggguaaaccaguucuauacccuggcccccauggguaauggcacugggagaaggcgguga

SEQ ID NO: 21367 - RNA, 1617 nt, Artificial Sequence
  derived and/or modified sequence opt3 from VP1__Norovirus_and/or_Norovirus-like__JN400613
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucagaggaaggagcuccgccuuggugguucauccccagaauggucgguguacgacugacggcgugcugcuagggaccacacagcucucaccugucaacauuugcacuuuccgcggagaugugacccacaucgcaggcagucauaauuacacaaugaaccuggcuagccuuaauuggaacaauuaugacccaaccgaagagauuccggcuccccuggguacgccugauuuuguagggaagauccaaggaguuuugacucagacaaccaagggcgacggcucuacucgagggcacaaggccacaguguacaccggauccgccccauucacgcccaaacucgguucaguccaguuuagcaccgacacagaaaacgauuucgagacucaccagaauaccaaguuuacaccugugggcgucauccaagacgggaguacuacccauagaaacgaaccacagcagugggugcugcccucuuacuccggaggcaauguucacaacgugcauuuagcaccggccguagcuccuacauucccaggugagcaacugcucuuuuucaggagcaccaugcccggguguucgggcuauccuaauauggaucuugacugccuguugccccaggaguggguccagcacuuuuaccaggaagcggcaccagcccaaucugauguggcucuacugcgguucguuaacccugacacuggacgugugcucuuugaguauaaacugcacaaguccgauuacgucacgguggcccauacaggccagcacgaccuuguaauucccccaaacggguauuuccgcuuugauucaugggugaaucaguucuacacccuggcagccaugggaaacgguacuggcagaaggcgguga

SEQ ID NO: 21368 - RNA, 1617 nt, Artificial Sequence
  derived and/or modified sequence opt3 from VP1__Norovirus_and/or_Norovirus-like__KX514291
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucacggguaagauucaggggaugcuuacucagacaaccaagggagaaggcucaacucgcggccaccgagccacaguuuacguggggagcgcuaauuacgccccaaagcugggaagaguccaguuugagaccgacacgaccaacgauuuggacgcacaucaaaauacaaaauucacucccgugggugucauccagggcggggaaagugcccacaggucugagccgcagcaaugggugcucccuuccuauagcggacgggauaccccaaacguucaccuggcucccgcgguggcaccuacauuucccggcgaacaguuacuguucuuucguucgacuaucccagguugugggggccauccuaauaugaaccucgacugccuucugccccaggaguggguacagcacuucuaccaagaggccgcuccagcccagucugaugucgcauugcuacgcuuugugaauccggacaccuccagaguucuguucgaauguaagcuccauaaaucaggauaugugacagucgcccacaccggccagcacgaucuggugauuccucccaacggguacuuuagguucgacaguuggguaaaccaguuuuauacucuugcuccaaugggaaaugguacgggccggaagcgauga

SEQ ID NO: 21369 - RNA, 1617 nt, Artificial Sequence
  derived and/or modified sequence opt3 from VP1__Norovirus_and/or_Norovirus-like__KX514219
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagacaccacgaacgauuuggacgcacaucaaaauaccaaauucacacccgucggugugguucagggcggggaaaguccgcagaggucugagccucaacagugggugcucccauccuauagcggacgggauacucccaacguacaccuggccccugcugucgcgcccaccuuuccaggcgaacaguuacuguucuuucguucgacacucccugguugugggggccaccccaauauggaccuugauugccuguugccacaggagugggugcaacauuucuaccaggaggcagccccggcucagucugacguugcccuacugcgcuuugugaacccugauacuuccagaguccucuucgaauguaagcugcacaaaucaggauaugugaccguagcacauacaggccaguacgaccuugugcugcccaguaauggguauuuuagguucgauagcuggguuaaccaauuuuacaccuuggccccaaugggaaacgguacuggccggcgacgcuga

SEQ ID NO: 21370 - RNA, 1617 nt, Artificial Sequence
  derived and/or modified sequence opt3 from VP1__Norovirus_and/or_Norovirus-like__AB933668
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagugguaaaaacuacgcucuccgcuguuccuccaaacuucccgaccgagggccugucucccucacaggugacaauguuuccucauaucauugucgacgugcgccaacuugagccagugcugauccccuugccugauguccgaaauaacuucuaucacuacaaucagucgaacgacagcacuauaaagcucaucgccaugcuguauaccccacugcgugcaaacaaugcuggcgaagauguuuuuacagugaguugcagaguacucaccaggcccuccccggacuucgauuuuauuuucuuagugccucccacugucgagucucggacaaaaccauuuaccgugccuauccugacgguugaagagaugacuaacagccgcuuccccauuccacuugagaaguuguuuaccgggcccuccucagccuucgugguccagccucagaauggaagauguacaacugacggugugcugcuaggcaccacacaacucaguccaguaaacaucugcaccuucaggggagauguuacgcauauagcggggagccggaauuacacuaugaaccuggccucucuuaauuggaacaauuaugacccgacagaagagauucccgcaccucugggcaccccagauuuuguggguaaaauccagggggucuugacucagacaaccaagggagacggcuccacgcgcggccacaaggcuaccguguacacagggucagcccccuucacuccuaaacucggaagcguccaguuuaguaccgacacagaaaacgauuucgagacucaucaaaauaccaaguuuacaccaguggguguuauucaggacggcgggaccacucaccgaaacgaaccccagcaaugggugcugccgucuuacuccggaagaaauguaccuaacguccacuuagcuccagccguggcacccacguucccuggcgagcagcugcucuuuuucaggagcacaaugcccgguuguucgggguauccaaauauggaucuugacugccuguugccucaggaguggguucagcauuuuuaccaagaagccgcucccgcgcagucugauguggcacuacugcgguucgucaacccagacaccggccgugugcucuuugaguguaaacugcacaaguccggauauguaacuguggcccauaccggccagcacgaucuuguuaucccgccuaacggguacuuccgcuuugacucaugggucaaucaguucuauacacuggcucccaugggaaacgguaccggcagaaggcgguga

SEQ ID NO: 21371 - RNA, 1617 nt, Artificial Sequence
  derived and/or modified sequence opt3 from VP1__Norovirus_and/or_Norovirus-like__KJ678149
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccaucaguccaaggaaugcccccggggagauucuuuggagcgcuccucugggaccagauuugaaccccuacuuaucccaccuggcccggauguauaauggcuacgcggguggguucgaaguucaggugauccuagcaggaaacgccuuuacagcuggcaaagucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaugacagcaccaucaaguugauugcuaugcucuauacaccacugcgugccaacaacgcgggggaugacgucuucacuguuaguugcagagugcugaccaggcccuccccggauuuugaccucaucuucuuaguaccucccacaguggaaucucggaccaaaccauuuagcgucccugugcugacuguugaggaaaugacaaauucccgcuuccccaccccacuugagaaguuguuuacgggacccucaagugccuucgugguccagccucagaacgguagauguacuaccgauggcgugcugcuagggacaacucaacucagcccaguaaauauuugcaccuucaggggagacguuacacauaucaccggcucucggaacuacacgaugaaucuggcaucccagaacuggucaaauuaugauccgacugaggaaauacccgcuccucuugguacaccagacuuuguggggaaaauucagggaguccugacccagacuacacgcaccgacggcagcacgcgaggccacaaggccaccguguacacagggagugcugauuucgcccccaaguugggaagaguccaauuugagacugacaccgaucaugacuucgaaacaaaccagaauacuaaauuuaccccuguggguguuauccaggauggcucuacaacccacaggaacgagccacaacagugggugcuccccuccuacagcgggcggaauacuccgaacguacaccuggccccugcagucgcuccaacguuccccggagaacaguuacuguuuuuccguucgacaauuccuggcuguucugguuaucccaauauggaccucgauugccuucugccacaggagugggugcaauacuuuuaucaggaggcggccccugcacaguccgacguugcuuugcuacgcuucgugaaccccgauaccgggagaguccuguuugaauguaagcuccauaaaucaggcuacgugacuguagcccacaccggacagcaugaccuggugaucccaccgaauggcuauuucagguuugauaguuggguuaaccaauucuacacacuugcaccuauggggaacggaaccggucggcgacgcuga

SEQ ID NO: 21372 - RNA, 1617 nt, Artificial Sequence
  derived and/or modified sequence opt3 from VP1__Norovirus_and/or_Norovirus-like__KP244318
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaaggaccuuucggggagacguaacacauauucccggcagccgcaacuacaccaugaacucugccucccagaauuggaacucauaugauccuacggaggaaaucccagcaccccucgguacuccugacuucguugggaagauucagggagugcugacacagaccacucgagcuaauggcagcacaagaggccacaaggccaccgucuacacggggagugcugacuuuucuccaaaacuuggaagggugcaauucgccaccgauacagacaaugauuuugagacuaaccagaauaccaaguucacacccgucggugugauccaggacggcuccacuaccccgcggaacgaaccucaacaguggguucugccaagcuacucggggcguaauauccauaacgugcacuuggcacccgccguagcuccuacauuucccggagagcagcuccuguucuuucgcucuaccaugccaggcugcuccgguuauccuaauauggauuuagacugucugcucccccaggaauggguccaauacuucuaucaggaggcggcaccagcccagucagauguggcccuucugagauuuguuaacccggacacugggaggguguuguucgagugcaagcuacacaaaaguggcuacgucacgguggcucauacaggacagcacgaucugguaauuccucccaacggcuauuuucgguucgacagcugggugaaucaauucuacacccucgcaccaauggggaacggaacuggucgacgcagauga

SEQ ID NO: 21373 - RNA, 1617 nt, Artificial Sequence
  derived and/or modified sequence opt3 from VP1__Norovirus_and/or_Norovirus-like__KX514362
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccaggcgguucuaagauuuacaccaugaaucucgcauccccgaacuggaauaacuaugaccccacagaggagaucccugcuccacuggggacccccgacuucguuggaaagauucagggcaugcuuacgcagacuacaaagggcgaagggucaacccggggacaccgcgccacuguguacgucgguagcgcuaauuacgccccuaaacugggccgagugcaguuugagacagauaccacggacgauuuggacgcacaucaaaacaccaaguucacaccagucggggugguucagggaggcgaaagucccaaagguucugagccgcagcaaugggugcucccuuccuauagcgggagagauacuccaaauguacaccuggcccccgcugucgcgccuaccuuucccggcgaacaguuacuguucuuuaggucgacaaucccaggauguggcgggcacccuaacaugaaucucgacugccuucugccccaggagugggugcagcauuucuaccaagaggcagccccagcucagucugauguugccuugcuacgguuugugaacccggacacuucccguguccuguucgaauguaagcuccacaaaucaggauaugugaccguagcacauacaggucagcacgaucuggugaucccucccaauggcuacuuucgcuucgacaguuggguuaaccaguuuuauacccuugccccaauggggaacggaacuggcagaaagagguga

SEQ ID NO: 21374 - RNA, 1617 nt, Artificial Sequence
  derived and/or modified sequence opt3 from VP1__Norovirus_and/or_Norovirus-like__KX514329
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggagcaaaccauucuccgugccugucuuaaccguggaggaaaugacuaauucacgcuuucccgccacacuggauaaacuuuucaccggaccaaguagcacguucguugugcagccccagaacgguagauguaugaucgacggcgucuugcuggggacuacccaacuaucuccugugaauauaugcacauuuaggggagauguaacucauuccggcaacucaaagauuuacaccaugaaucucgcaagcccaaacuggaauaacuaugacccgacagaggagauccccgcuccucuggguaccccagacuucguugggaagauucagggaaugcuuacgcagacuacaaagggcgaaggcaguacccgggggcaccgcgccacuguguacgucggaucugcuaauuacgcccccaaacugggucgagugcaguuugagacagauaccacggacgauuuggacgcacaucaaaacaccaaguucacaccugucggcgugguucaagggggagaauccccaaaaggcagcgagccccagcagugggugcucccgucguauucugguagagauacuccuaauguacaccuggccccagcugucgcgcccaccuuuccuggggaacaguuacuguucuuuagguccacaauccccggcuguggaggccacccaaacaugaaucucgacugccuucugccucaggagugggugcagcauuucuaccaagaggcagcccccgcucagucagauguugccuugcuacgguuugugaacccagacaccagucguguccuguucgaauguaagcuccacaaaagcggguaugugacuguagcacauacaggacagcacgaucuggugaucccgccuaaugguuacuuucgcuucgacuccuggguuaaccaguuuuauacccuugcccccaugggcaacgggacuggaagaaagagguga

SEQ ID NO: 21375 - RNA, 1617 nt, Artificial Sequence
  derived and/or modified sequence opt3 from VP1__Norovirus_and/or_Norovirus-like__KJ678152
augaagauggccagcuccgacgcuaaccccugcgauggcucugcagccaaucuggugccugaggucaacaaugaaguuauggcgcucgagccagugguaggggcugccaucgcagccccggugggaggucagcaaaacgucauugaccccuggauaagaaauaacuucgugcaggcuccuggcggggaauuuaccguuucaccaaggaaugcacccggagagauccuuuggagugccccucugggcccagauuugaaccccuacuuaagccaccuggcucggauguauaaugguuacgccgggggauucgaagugcaggucauucuagcgggcaacgcauuuacagccggcaaagugaucuucgcugccguaccuccaaauuuuccgacugaggggcucucccccucucagguuacgauguucccucauauuguggucgacgugcgccaacuggagccagugcuuaucccccugccugauguccgaaacaauuuuuaucacuacaaccagucgaaugacucaaccauaaaguugaucgcaaugcucuauacaccacugcgugcuaacaacgccggagaugacguuuucacugugagcuguagaguacugaccaggcccaguccggauuuugacuucauuuuucucgugccucccacagucgaaucccggaccaaaccauucucugugccuguuuuaacuguggaggaaaugacaaauagccgcuuucccaccccacuggagaaacuuuucacgggucccuccucagcguucgucgugcagccucagaacggcagaugcacuaccgaugggguauugcugggaacaacucaacuaaguccaguuaauaucuguaccuuuaggggcgacgugacacauauuaccgguagccggaacuacacgaugaaucucgccucucagaacugguccaauuaugauccgacugaggaaauccccgcaccucuggggacaccagacuucgucggaaagauacagggcgugcuuacccagacuacacgcaccgacggcucaacgcgagggcacaaggcuaccgucuacauuggaagcgccgauuuugcucccaagcuggguagagugcaauucgagacagacacugaucaugacuuugaaaccaaccagaauacaaaauucacuccuguuggcgugauccaggaugggaguaccacacacaggaacgagccacaacaguggguauugcccucuuacuccggacggaauaccccgaacguccaccucgccccugcaguggccccaacuuuucccggcgaacagcuguuauucuuucguagcacgcugccugguugcucgggguaucccaauauggaccucgauugucuucugccacaggaguggguucaauacuucuaucaggaggcugcgccugcacagucugacguggccuugcuacgcuuugucaaccccgauacaggcagagugcuguucgaaugcaagcuccauaaauccggauacguaaccguggcucacacuggccagcaugaccugguuauuccaccgaauggguauuuuagguucgauucaugggucaaccaauucuacacccuugccccuaugggaaacgguacaggccggcgacgcuga

SEQ ID NO: 21376 - RNA, 1617 nt, Artificial Sequence
  derived and/or modified sequence opt3 from VP1__Norovirus_and/or_Norovirus-like__KX514352
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagacaccacgaacgauuuguaugcacaucaaaauaccaaauucacacccgucggugugguucagggcggggaaagugcccacaggucugagccgcagcaaugggugcucccuggauacuccggccgggacacuccaaacguacaccuggcucccgcggucgcaccuaccuuucccggugaacaguuacuguucuuucguagcacaaucccaggguguggcggacauccuaauauggaucucgacugccuucugccccaggagugggugcagcacuucuaucaagaggccgcuccagcccagucggauguugcauugcuacgcuuugugaacccggacacuucuagaguccuguucgaauguaagcuccauaaauccggcuacgugaccguagcccacacagggcagcacgaucuggugaucccucccaauggauauuuuagguucgacucauggguuaaccaguuuuacacccuugcuccaauggguaacggcacugggcggaagcgauga

SEQ ID NO: 21377 - RNA, 1617 nt, Artificial Sequence
  derived and/or modified sequence opt3 from VP1__Norovirus_and/or_Norovirus-like__KX514339
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggagcaaaccauucuccgugccugucuuaacuguggaggaaaugacaaauucacgcuuucccgcgacccuggauaaacuuuucacgggaccaaguagcacuuucguugugcagccccagaacgguagauguaugaucgacggcgucuugcuggggaccacacaacuaucuccugugaauauaugcacuuuuaggggagauguaacccaguccggcaacacaaagauuuacaccaugaaucucgccucaccaaacuggaauaacuaugacccgacggaggagauccccgcaccucuggguacuccagacuucguugggaagauucagggaaugcuuacacagaccacuaagggcgaaggcagcacacgggggcaucgcgcuaccguguacgucggaagugccaauuacgcucccaaacugggucgagugcaauuugagacggauaccacagacgauuuggacgcccaccagaacacuaaguucaccccugucggcgugguucaagggggagaaucuccaaaaggcuccgagccccagcagugggugcucccgagcuauucggguagagauacaccuaauguacaucuggcaccagccgucgcucccacuuuuccuggggaacaguuacuguucuuuaggucuaccauccccggcuguggaggccacccaaacaugaaucucgacugccuucugccucaggagugggugcaacacuucuaccaggaggcggcacccgcccaguccgauguugcuuugcuacgguuugugaacccagacacaucacguguccuguucgaauguaagcuccauaaaaguggguaugugaccguagcccacacuggacagcaugaucuggugaucccgccuaaugguuacuuucgcuucgacagcuggguuaaccaauuuuauacgcuugcacccaugggcaacgggacaggaagaaggcgguga

SEQ ID NO: 21378 - RNA, 1617 nt, Artificial Sequence
  derived and/or modified sequence opt3 from VP1__Norovirus_and/or_Norovirus-like__KR904238
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacacacaauguucaucucgccccggcuguggcgccuaccuuuccaggagaacagcugcccuucuuucguagcacuaugccuggcuguucggguuaucccaacauggacuuagauugccugcucccacaggaguggguacaauacuucuaucaggaggcagccccugcucagucugacgucgcccuucugcgcuuugugaaucccgauacggggagaguuuuguucgaauguaagcuacacaaauccggcuacgugacagucgcacauaccggacagcacgaccuggugaucccaccguauggcuacuuuagguucgauucauggguaaaccaauucuauacucucgccccuauggggaacggaaccggucggcgacgcuga

SEQ ID NO: 21379 - RNA, 1617 nt, Artificial Sequence
  derived and/or modified sequence opt3 from VP1__Norovirus_and/or_Norovirus-like__KJ710245
augaagauggccagcuccgacgcuaaccccucugauggcucaaccgcaaaucuggugccugaggucaacgacgaaguuauggcccucgagccagugguaggggcggcucuugccgcaccgguggccggacagcaaaaugucaucgaucccuggauuagaaacaauuucgugcaggcuccugguggcgaauuuacaguuaguccaaggaacgcacccggggagauacuguggagcgccccuuugggaccagacuuaaaucccuaccugucccaccuagcucggauguauaacggcuacgccgguggguucgaagugcaggucauccucgcgggaaaugcauuuacugccggcaaagugauuuucgcugccguaccuccaaacuuuccgacggagggccugucucccucgcagguuaccauguucccucauaucauuguggauguccgccaacuugagccagugcugauccccuugccugacgcacgaaauaacuuuuaucacuacaaucagucaaacgaaagcacaauaaagcucaucgcuaugcuguauacuccacugcgugccaauaacgcgggggaugacguguucaccgucaguugcagaguucucacaaggcccuccuuagauuuugacuucauuuuucuggugccgccuaccguagagucucggacuaaacccuucagcgugccaauccuuacagucgaagagaugaccaacucccgcuuuccuauucccuuggagagacuguucacgggaccaucaagugccuucgcagugcagccccagaaugguagguguacuaccgauggcguucuacucgggacaacucaacugagcccugugaacaucugcaccuuucggggagacgucacacauaccacgggcucucacaauuacacuaugaaccuugcuucccagaaucgcucaaacuaugauccaacagaagagauaccggcuccccuggguaccccugacuucguggggaagauucagggagccuugacucagacaacccgagccgacggcagcacgagaggccauaaagcaaccguauacacagggagugccgauuuuacuccaaagcucggaaggguucaauucgcuaccgacacagaucacgacuuugauacuaaucagaacaccaaguucacacccgugggugucauccaggacggcucuaccacucaccggaaugaaccucaacagugggugcugccauccuacagcgggcguaacacgcauaauguccacuuagcgcccgcaguggccccgacauuuccuggagagcagcuccuguucuuucgcucgaccaugccaggcuguucugguuaucccaacauggaucuugacugccuguugccucaggaauggguugcucauuucuaccaagaggccgcacccgcccaguccgauguggcucuacugagauuuguaaauccagacacugggaggguccucuucgaguguaaacugcacaagucaggcuaugugaccguugcccacacaggacagcaugaucuugugauuccucccaacggcuacuuucgguucgacaguugggucaaucaguucuauacccuggcaccaauggggaacggaacuggucgacgcagauga

SEQ ID NO: 21380 - RNA, 1617 nt, Artificial Sequence
  derived and/or modified sequence opt3 from VP1__Norovirus_and/or_Norovirus-like__KX514298
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagacaccacgaacgauuuggacgcacaucaaaauaccaaauucacacccgucggugugauccagggcggggaaagugcccacaggucugagccgcagcaauggguucucccuuccuauagcggacgggauaucccaaacgugcaccuggcucccgcgguagcaccuacuuuucccggcgaacaguuacuguucuuucguucgaccauuccagguugugggggccauccuaauaugaaccucgacugccuucugccccaggaguggguccagcacuucuaccaagaggccgcuccagcccagucugauguggcauugcuacgcuuuguuaauccggacacauccagagugcuguucgaauguaagcuccauaaaucaggauaugucacuguggcccacaccggccagcacgaucugguaauaccucccaacggguacuuuagguucgacaguugggugaaccaguuuuauacacuugcuccaaugggaaaugguaccggccggaagcgauga

SEQ ID NO: 21381 - RNA, 1617 nt, Artificial Sequence
  derived and/or modified sequence opt3 from VP1__Norovirus_and/or_Norovirus-like__KX514269
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucacggguaagauucaggggaugcuuacucagacaaccaagggagaaggcucaacucgcggccaccgagccacaguuuacguggggagcgcuaauuacgccccaaagcugggaagaguccaguuugagaccgacacgaccaacgauuuggacgcacaucaaaauacaaaauucacucccgugggugucgugcagaguggcgaaucuccgaagggguccgagccucagcaauggguucucccaagcuauucgggaagggauacccccaacgugcaccuggccccugcuguagcgcccacauuuccaggcgaacaguuacuguucuuucggucuacuaucccugguugugggggccaccccaauaugaaccucgacugccuucugccacaggaguggguccagcauuucuaccaagaggcagccccggcucaguccgauguggccuugcuacguuuuguuaauccugacaccucacgcgugcuguucgaauguaaacuccacaagaguggauaugucacaguggcacauaccggccagcacgaucugguaauucccccaaacggguacuuuagauucgacagcugggugaaccaguuuuauacucuugcccccaugggaaaugguacgggcaggaaacgguga

SEQ ID NO: 21382 - RNA, 1617 nt, Artificial Sequence
  derived and/or modified sequence opt3 from VP1__Norovirus_and/or_Norovirus-like__KX514179
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucucagauuuacaccaugaaucucgcauccccgaacuggaauaacuaugaccccacagaggagaucccugcuccacugggcacccccgauuucguugguaagauucaggggaugcuuacgcagacuacaaagggagaaggcucaacccgcggccaccgagccacuguguacgucgggagcgcuaauuacgccccuaagcugggaagagugcaauuugagacagacaccacgaacgauuuggacgcacaucagaauaccaaauucacaccagucggugugguucagggcggggaaagucccaagggaucugagccgcaacagugggugcucccuuccuauagcggcagggauacuccaaacguacaccuggcccccgcugucgcgccuaccuuucccggugaacaguuacuguucuuucggucgacaaucccaggguguggcggacacccuaauaugaaccucgacugccuucugccccaggagugggugcaacauuucuaccaggaggcagccccagcucagucugauguugccuugcuacguuuugugaauccggacacuucccgcguccuguucgaauguaaacuccacaagucaggcuaugugaccguagcacauacagggcagcacgaucuggugaucccucccaacggauacuuuagauucgacaguuggguuaaccaauuuuauacccuugccccaauggguaauggcacugggaggaaacgguga

SEQ ID NO: 21383 - RNA, 1617 nt, Artificial Sequence
  derived and/or modified sequence opt3 from VP1__Norovirus_and/or_Norovirus-like__KX514289
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagacaccacgaacgauuuggacgcacaucaaaauaccaaauucacacccgucggugugguucagaguggcgaaucuccgaagggguccgagccucagcaaugggugcucccaagcuauucgggaagggauacucccaacguacaccuggccccugcugucgcgcccaccuuuccaggcgaacaguuacuguucuuucggucuacaaucccugguugugggggccaccccaauaugaaccucgacugccuucugccacaggagugggugcagcauuucuaccaagaggcagccccggcucaguccgauguugccuugcuacguuuugugaauccugacacuucacgcguccuguucgaauguaaacuccacaagaguggauaugugaccguagcacauacaggccagcacgaucuggugauucccccaaacggguacuuuagauucgacagcuggguuaaccaguuuuauacccuugcccccaugggaaaugguacuggcaggaaacgguga

SEQ ID NO: 21384 - RNA, 1617 nt, Artificial Sequence
  derived and/or modified sequence opt3 from VP1__Norovirus_and/or_Norovirus-like__KX514288
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagacaccacgaacgauuuggacgcacaucaaaauaccaaauucacacccgucggugugguucagaguggcgaaucuccgaagggguccgagccucagcaaugggugcucccaagcuauucgggaagggauacucccaacguacaccuggccccugcugucgcgcccaccuuuccaggcgaacaguuacuguucuuucggucuacaaucccugguugugggggccaccccaauauggaccucgauugccuucugccacaggagugggugcagcauuucuaccaagaggcagccccggcucaguccgacguugccuugcuacguuuugugaacccugauacuucacgcguccuguucgaauguaaacuccacaagaguggauaugugaccguagcacauacaggccagcacgaccuggugauucccccaaauggguacuuuagauucgauagcuggguuaaccaguuuuauacccuugcccccaugggaaacgguacuggcaggaaacgguga

SEQ ID NO: 21385 - RNA, 1617 nt, Artificial Sequence
  derived and/or modified sequence opt3 from VP1__Norovirus_and/or_Norovirus-like__KX514268
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucacgggaugcuuacgcagacuacaaagggagaaggcucaacccgcggccaucgagccacuguguacgucgggagcgcuaauuacgccccaaagcugggaagagugcaguuugagacagacaccacgaacgauuuggacgcacaccagaauaccaaauucacacccgucggugugguucaaggcggggaaaguccgaagggaucugagccucagcagugggugcucccauccuauagcggcagggauacucccaacguacaccuggccccugcugucgcgcccaccuuuccaggugaacaauuacuguucuuucggucgacaaucccuggguguggcggacaucccaauaugaaccucgacugccuucugccacaggagugggugcagcacuucuaccaggaggcagccccggcucaaucugauguugccuugcuacguuuugugaauccugacacuucccgcguccuguucgaauguaaacuccauaagucaggcuaugugaccguagcacacacagggcagcacgaucuggugauucccccaaacggauacuuuagauucgacaguuggguuaaccaguuuuauacccuugcccccauggguaauggcacugggaggaaacgguga

SEQ ID NO: 21386 - RNA, 1617 nt, Artificial Sequence
  derived and/or modified sequence opt3 from VP1__Norovirus_and/or_Norovirus-like__JX459653
augaagauggccagcuccgaccccaacccuucugauggcucaaccgcuaaucuggugccagaggucaacaaugaaguuauggcacucgagccggugguaggggccgcgaucgcugcccccguggcaggacagcaaaacgucauugacccuuggauaagaaauaacuucgugcaggccccagguggcgaauuuacaguuagucccaggaaugcuccuggggagauccuuuggagcgcaccacugggacccgauuugaacccuuacuuaucccaccuggcccggauguauaauggcuacgcugguggguucgaagugcaggucauucuagccggaaacgcguuuacugcaggcaaaaucauuuucgccgcugugccaccgaauuuucccacggagggccucucuccuucgcagguaaccauguucccacauaucauaguugacgugcgccaacuggagcccguccuuaucccucugccagaugugcgaaacaauuuuuaucacuacaaccagucaaaugacagcaaguugaaacuccgucccaugcuguauacaccgcugagagccaacaacgcaggggaugacguguucacugucaguugcaggguucucacccggccuucccccgauuuugacuucaucuuuuuagugccaccuacaguagaaucucgcaccaagcccuucagcgugccaguccugacuguggaggaaaugacaaauuccagauuucccaucccucuugagaaauuguucaccggaccaucaagugcuuucguugugcagccgcagaacgguagguguacgacugauggcguccugcuagggaccacacaacucagccccgugaauauuugcacuuuucggggagacguaacccauaucccuggcucucgcaacuacacaaugaaucuggccucccagaacuggaacucauaugauccaaccgaggaaauacccgcgccucuugguacgccagacuucguugggaagauucagggagugcugacucagacaacccgaacuaauggcagcacaagaggccacaaggccaccgucuacacggggagugcagacuuuucucccaaauugggaagggugcaauucgcuaccgauacagacaaugauuuugagacuaaccagaauaccaaguucacaccggucggugugauccaggacggcuccacuaccccucggaacgaaccacaacaguggguucuccccagcuacucggggcguaauauucauaacgugcaccuggccccugcuguagcccccacauuuccaggagagcaguuacuguucuuucgcucuaccaugccuggcuguuccgguuaucccaauauggaucucgacugccuucugccacaggaauggguccaauacuucuaucaggaggcagccccggcucagucagauguggcguugcuaagauuuguuaacccugacacugggagggugcuguucgaguguaaacuccacaagaguggcuacgucacgguggcacauacaggacagcacgaucugguaauucccccaaacggcuauuuucgguucgacagcugggugaaucaauucuacacccuugcccccauggggaacggaacuggucgacgcagauga

SEQ ID NO: 21387 - RNA, 1617 nt, Artificial Sequence
  derived and/or modified sequence opt3 from VP1__Norovirus_and/or_Norovirus-like__KX514359
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagacaccacgaacgauuuggacgcacaucaaaauaccaaauucacacccgucggugugguucagggcggggaaaguccgcagaggucugagccucaacagugggugcucccauccuauagcggacgggauacucccaacguacaccuggccccugcugucgcgcccaccuuuccaggcgaacaguuacuguucuuucguucgacaaucccugguugugggggccaccccaauaugaaccucgacugccuucugccacaggagugggugcaacauuucuaccaggaggcagccccggcucagucugauguugccuugcuacgcuuugugaauccugacacuuccagaguccuguucgaauguaagcuccacaaaucaggauaugugaccguagcacauacaggccagcacgaucuggugauucccccaaacggguacuuuagguucgacaguuggguuaaccaauuuuauacccuugcccccaugggaaaugguacuggccggaagcgauga

SEQ ID NO: 21388 - RNA, 1617 nt, Artificial Sequence
  derived and/or modified sequence opt3 from VP1__Norovirus_and/or_Norovirus-like__KX514296
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagguaccacgaacgacuuggaugcacaucaaaauaccaaauucacacccgucggcgugguucaagggggagaaaguccgcagggcucugagccucagcagugggugcucccauccuauagcgguagggacacucccaacguacaccuggccccugcugucgcgcccaccuuuccaggggaacaguuacuguucuuucggucgacaaucccuggcuguggaggccaccccaauaugaaccucgauugccuucugccacaggagugggugcaacauuucuaccaggaggcagccccggcucagucugacguugccuugcuacguuuugugaauccugauacuucccgcguccuguucgaauguaagcuccacaaaucaggguaugugaccguagcacauacaggacagcacgaccuggugauucccccaaacgguuacuuuagauucgauaguuggguuaaccaauuuuauacccuugcccccaugggcaaugggacuggaaggaagcgguga

SEQ ID NO: 21389 - RNA, 1617 nt, Artificial Sequence
  derived and/or modified sequence opt3 from VP1__Norovirus_and/or_Norovirus-like__KX514284
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagacaccacgaacgauuuggacgcacaucaaaauaccaaauucacacccgucggugugguucagggcggggaaaguccgcagaggucugagccucaacagugggugcucccauccuauagcggacgggauacucccaacguacaccuggccccugcugucgcgcccaccuuuccaggcgaacaguuacuguucuuucguucgacaaucccugguugugggggccaccccaauauggaccucgauugccuucugccacaggagugggugcaacauuucuaccaggaggcagccccggcucagucugacguugccuugcuacgcuuugugaacccugauacuuccagaguccuguucgaauguaagcuccacaaaucaggauaugugaccguagcacauacaggccagcacgaccuggugauucccccaaauggguacuuuagguucgauaguuggguuaaccaauuuuauacccuugcccccaugggaaacgguacuggccggaagcgauga

SEQ ID NO: 21390 - RNA, 1617 nt, Artificial Sequence
  derived and/or modified sequence opt3 from VP1__Norovirus_and/or_Norovirus-like__KX514245
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagacaccacgaacgauuuggacgcacaucaaaauaccaaauucacacccgucggugugguucagggcggggaaaguccgcagaggucugagccucaacagugggugcucccauccuauagcggacgggauacucccaacguacaccuggccccugcugucgcgcccaccuuuccaggcgaacaguuacuguucuuucguucgacaaucccugguugugggggccaccccaauaugaaccucgacugccuucugccacaggagugggugcaacauuucuaccaggaggcagccccggcucagucugauguugccuugcuacgcuuugugaauccugacacuuccagaguccuguucgaauguaagcuccacaaaucaggauaugugaccguaacacauaccggccagcacgaucuggugauucccccaaacggguacuuuagguucgacaguuggguuaaccaauuuuauacucuugcacccaugggaaaugguacgggccggaagcgauga

SEQ ID NO: 21391 - RNA, 1617 nt, Artificial Sequence
  derived and/or modified sequence opt3 from VP1__Norovirus_and/or_Norovirus-like__KX514327
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaacgccggggaugacguguucacagucaguugcagaguucugaccaggcccuccccggauuuugacuucauuuuucucgugccucccacuguagaaucucggagcaaaccauucuccgugccugucuuaacaguggaggaaaugaccaacucacgcuuucccgcgacgcuggauaaacuuuucacuggaccaaguagcaccuucguugugcagccccagaaugguagauguaugaucgacggcgucuugcuggggacaacucaacuaucuccugugaacauaugcaccuuuaggggagauguaacacauuccggcaauucaaagauuuacaccaugaaccucgccagcccaaauuggaacaauuaugacccgacggaggagauccccgcaccucuggguacuccagacuucguugggaagauucagggaaugcuuacacagaccacuaagggcgaaggcaguacacgggggcaccgcgcuaccguguacgucggaucugccaacuacgcucccaaacugggucgagugcaguuugagacggauaccacagacgauuuggacgcccaucaaaauacuaaguucaccccugucggcgugguucaagggggagaauccccaaaaggcagcgagccccagcagugggugcucccgucguauucugguagagauacaccuaacguacaccuggcaccagccgucgcucccacuuuuccuggggaacaguuacuguucuuuagguccaccauccccggcuguggaggccacccaaauaugaaccucgacugccuucugccucaggagugggugcagcauuucuaccaagaggcggcacccgcccagucagauguugcuuugcuacgguuugugaauccagacacaagucguguccuguucgaauguaagcuccacaaaagcggguaugugaccguagcccauacuggacagcacgaucuggugaucccgccuaacgguuacuuucgcuucgacuccuggguuaaucaguuuuauacgcuugcacccaugggcaacgggacaggaagaaagagguga

SEQ ID NO: 21392 - RNA, 1617 nt, Artificial Sequence
  derived and/or modified sequence opt3 from VP1__Norovirus_and/or_Norovirus-like__KX514301
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagacaccacgaacgauuuggacgcacaucaaaauaccaaauucacacccgucggugugguucagggcggggaaaguccgaagggaucugagccucagcaaugggugcucccauccuauagcggcagggauacucccaacguacaccuggccccugcugucgcgcccaccuuuccaggugaacaguuacuguucuuucggucgacaaucccuggguguggcggacaccccaauaugaaccucgacugccuucugccacaggagugggugcagcauuucuaccaagaggcagccccggcucagucugauguugccuugcuacguuuugugaauccugacacuucccgcguccuguucgaauguaaacuccacaagucaggcuaugugaccguagcacauacagggcagcacgaucuggugauucccccaaacggauacuuuagauucgacaguuggguuaaccaguuuuauacccuugcccccauggguaauggcacugggaggaaacgguga

SEQ ID NO: 21393 - RNA, 1617 nt, Artificial Sequence
  derived and/or modified sequence opt3 from VP1__Norovirus_and/or_Norovirus-like__KX514299
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucaggggaugcuuacgcagacuacaaagggagaaggcucaacccgcggccaccgagccacuguguacgucgggagcgcuaauuacgccccaaagcugggaagagugcaguuugagacagacaccacgaacgauuuggacgcacaucaaaauaccaaauucacacccgucggugugguucagggcggggaaaguccgcagggaucugagccucaacagugggugcucccauccuauagcggcagggauacucccaacguacaccuggccccugcugucgcgcccaccuuuccaggugaacaguuacuguucuuucggucgacaaucccuggguguggcggacaccccaauaugaaccucgacugccuucugccacaggagugggugcaacauuucuaccaggaggcagccccggcucagucugauguugccuugcuacguuuugugaauccugacacuucccgcguccuguucgaauguaagcuccacaaaucaggcuaugugaccguagcacauacagggcagcacgaucuggugauucccccaaacggauacuuuagauucgacaguuggguuaaccaauuuuauacccuugcccccauggguaauggcacugggaggaagcgguga

SEQ ID NO: 21394 - RNA, 1617 nt, Artificial Sequence
  derived and/or modified sequence opt3 from VP1__Norovirus_and/or_Norovirus-like__KX514277
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagaauugaaucccuacuuaagccaccuggcccggauguauaacggcuacgcggguggguucgaggugcaggucauucuagcaggaaaugccuuuacagcuggcaaaaucauuuucgccgcagugccuccaaacuuuccgacugagggccucucccccucucagguaacgauguucccucauaucauaguugaugugcgccaacuggaaccaguccuuaucccccugccugacgugcgaaauaacuuuuaucacuacaaucagucgaacgauucaaccauuaaguugaucgcuaugcucuauacaccacugcgugccaacaaugcgggggacgauguguucacugucagcugcagaguucugaccaggcccaguccggacuuugauuucauuuuucucgugccucccacaguagagucccggucuaaaccauucagcgugccugucuuaaccguggaagagaugacuaacucccgcuuucccgccacacuggacaaacuuuucaccggaccaucaaguacguucguugugcagccccagaaugguagauguaugaucgauggcgucuugcuggggacuacccaacuaagcccugugaacauaugcacauuuaggggagacguaacucauccacgggauucuccgauuuacaccaugaaucucgcaucccccaacuggaauaacuaugacccuacagaggaaaucccagcuccccugggcaccccugacuucguugguaagauucaggggaugcuuacgcagacuacaaagggagagggcucaacccgcggccaccgagccacuguguacgucgggagcgcuaauuacgccccaaagcugggaagagugcaguuugaaacagauaccacgaacgacuuggaugcacaucaaaauaccaaauucacacccgucggugugguucagggcggggagaguccgaagggaucugaaccucagcaaugggugcucccauccuauagcggcagggacacucccaacguacaccuggccccugcugucgcgcccaccuuuccaggugagcaguuacuguucuuucggucgacaaucccuggguguggcggacaccccaauaugaaccucgauugccuucugccacaggagugggugcagcauuucuaccaagaagcagccccggcucagucugacguugccuugcuacguuuugugaauccugauacuucccgcguccuguucgaguguaaacuccacaagucaggcuaugugaccguagcacauacagggcagcacgaccuggugauucccccaaacggauacuuuagauucgauaguuggguuaaccaguuuuauacccuugcccccauggguaauggcacugggaggaaacgguga

SEQ ID NO: 21395 - RNA, 1617 nt, Artificial Sequence
  derived and/or modified sequence opt3 from VP1__Norovirus_and/or_Norovirus-like__KX514213
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccgugcaggagaugacuaacucccgcuuucccgccacacuggauaaacuuuucaccggaccaucaaguaauuugguugugcagccccaaaacgguagauguaugaucgacggcguccugcuagggacgacucagcucagcccugugaauauaugcaccuucaggggagauguaacacauccacgggacucuccgauuuacacuaugaaccuggcaucccccaauuggaacaauuaugacccuaccgaagagaucccagcuccccuuggcacaccugauuuuguugguaagauucaggggaugcugacccagacgacuaagggagagggcucaacacgcggccaccgagccaccguguacgucgggagcgcuaacuacgccccaaaguugggaagagugcaauucgaaacugacacaaccaaugaucucgacgcacaucagaacacgaaauuuacccccgucggugugguucagggcggggagaguccgcaaaggucugaaccucagcagugggugcugccauccuauagcggacgggauacacccaauguacacuuagccccugcugucgcgcccacuuucccaggcgagcagcugcucuuuuuccguucgaccaucccugguugugggggccaccccaacaugaaucuugacugccuguugccacaagaaugggugcagcauuuuuaccaggaggcagccccggcucagucugauguugcccuacugcgcuucgugaacccugacacauccagaguccucuuugaguguaagcugcacaaaucaggauaugugacuguagcacauaccggccaacacgaucuugugauucccccaaacggguacuucagguuugacaguuggguuaaucaguucuauacacuggcccccaugggaaacgguaccggccggaagcgauga

SEQ ID NO: 21396 - RNA, 1617 nt, Artificial Sequence
  derived and/or modified sequence opt3 from VP1__Norovirus_and/or_Norovirus-like__KT033903
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccgggggagauguguucaccgucaguugcagaguucugacaaggcccuccccggacuuugauuucauuuuucucgugccucccaccguagaaucucggacuaaaccauucagcgugccugucuuaacaguggaggaaaugaccaauucccgcuuucccaucccacuggagaaacuuuucacgggucccucaagugcguucguugugcagccucagaacggcagauguacuaccgacggggucuugcugggaacaacucaacuaagcccagugaauauaugcaccuuuaggggcgauguaacacauauuccggguucucggaacuacaccaugaaucucgccucccagaacuggaacucauaugaccccacggaggaaaucccugcaccacuggggacucccgauuucguuggaaaggugcagggcguccuuacacagaccacucgcacaaauggcagcacccgagggcacaaggcuacgguguacaccggaagugccgacuuuucuccuaagcuggguagaguccaauucgcuacagacacugauaaugacuuugagaccaaccagaauacaaaauucacuccagugggcguuauucaggauggguccaccacacccaggaacgaaccgcaacaguggguguugccuagcuacucgggacggaauauccauaacguacaccucgccccagcagucgcccccaccuuuccuggcgagcagcuguuauucuuucguucuacuaugcccgguuguuccggguauccaaauauggaccuggauugccuccuuccucaggaaugggugcaauacuucuaucaggaggcugcgcccgcacagucagacguugcccuguugcgcuuugugaacccagauacggucagagugcuauucgaguguaagcugcacaaaaguggcuacguaacaguggcucauaccggacagcacgaccucguuaucccgccuaacggcuauuuuagguucgauagcugggucaaucaauucuacacucuggcccccauggggaacggaaccggucggcgacgcuga

SEQ ID NO: 21397 - RNA, 1617 nt, Artificial Sequence
  derived and/or modified sequence opt3 from VP1__Norovirus_and/or_Norovirus-like__HM625866
augaagauggccagcuccgacgcuaaccccucugauggcucaaccgcaaaucuggugccugaggucaacaaugaaguuauggcccucgagccagugguaggggcggcuagugccgcaccgguggccggacagcaaaacgucaucgaccccuggauuagaaauaacuucgugcaggcuccugguggcgaauuuacagagagcccaacuaaugcacccggggaaauacuuugguccgccccucugggaccagauuugaaccccuacuuaucucaccuggcuaggauguauaauggcuacgccgguggguucgagguucaggugauccuagcgggaaacgcauuuacggccggcaaaauuaucuucgcugccgucccuccaaauuuuccgaccgagggccucucgcccucacaggugacaauguucccucauauuaucguagacguucggcaacuggaaccagugcuuauaccccugccugauguccgcaacaauuuuuaucacuacaaccagagcaaugacccaacuaucaaguugauugcaaugcucuauacgccccugcgagcuaacaacgccggggaugacguguucacagugaguugccguguccugaccagaccguccccugauuuugacuucaucuuucucguucccgcgacuguggagucuaggacaaaaccauucagcguaccuguguuaaccgucgaagagaugaccaauucccgguuucccauuccacuggagaaacuuuucacuggacccucaagugccuucgugguucagccucagaacggucgcuguaccacagauggcguguugcuggggacuacccaacuaagcccagucaauaucugcacauuuagaggagacgugacccauauaccgggcucuaggaacuacacgaugaaucucgcaucccagaacuggaacucauaugaucccacugaagagauuccugcuccaguagguacacccgacuucguugggaagauccagggagugcugacccagacuacacggaccaauggcagcacgcgcggccacaaggccaccgucuacacagggagugcugacuuuucuccuaaacuuggacgagugcaauucgccacugauaccgacaaugauuuugaaacaaaccagaauacuaaguucaccccagucggugugauucaggacggcuccacaacccccagaaacgagccgcaacaguggguucugccuagcuacucggggaggaauauccauaacgugcacuuggcaccagccguagcucccacuuuuccuggagaacagcuccuguucuuucggucuacgaugcccggcuguuccgguuauccaaauauggauuuagacugccugcucccucaggaguggguccaauacuucuaucaggaggcggcacccgcccagucagauguggcccuucugcguuuuguuaacccagacacagggcgcguguuguucgaauguaagcuacacaaaaguggcuacgucaccguggcucauacuggacagcacgaucugguaaucccgccuaacggcuauuuuagauucgacagcugggugaaucaauucuacacccucgcacccauggggaacggaacagguaggcggcgauga

SEQ ID NO: 21398 - RNA, 1617 nt, Artificial Sequence
  derived and/or modified sequence opt3 from VP1__Norovirus_and/or_Norovirus-like__KX514319
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaacgccggggaugacguguucacagucaguugcagaguucugaccaggcccuccccggauuuugacuucauuuuucucgugccucccacuguagaaucucggagcaaaccauucuccgugccugucuuaacaguggaggaaaugaccaacucacgcuuucccgcgacgcuggauaaacuuuucacuggaccaaguagcaccuucguugugcagccccagaaugguagauguaugaucgacggcgucuugcuggggacaacucaacuaucuccugugaacauaugcaccuuuaggggagauguaacacauccaggcgguuccaagauuuacaccaugaaucucgccucaccgaacuggaauaacuaugaccccacggaggagaucccugcaccacuggggacucccgacuucguuggaaagauucagggcaugcuuacacagaccacuaagggcgaagggagcacacggggacaccgcgcuaccguguacgucgguagugccaauuacgcuccuaaacugggccgagugcaguuugagacggauaccacagacgauuuggacgcccaucaaaacacuaaguucaccccagucggggugguucagggaggcgaaucucccaaagguuccgagccgcagcaaugggugcucccuagcuauucggggagagauacaccaaauguacaccuggcacccgccgucgcuccuacuuuucccggcgaacaguuacuguucuuuaggucuaccaucccaggauguggcgggcacccuaacauggaccucgauugccuucugccccaggagugggugcagcauuucuaccaagaggcggcaccagcccaguccgacguugcuuugcuacgguuugugaauccggauacaucacguguccuguucgaauguaagcuccacaaaaguggauaugugaccguagcccauacuggucagcacgaccuggugaucccucccaacggcuacuuucgcuucgauagcuggguuaaucaguuuuauacgcuugcaccaauggggaacggaacaggcagaaggcgguga

SEQ ID NO: 21399 - RNA, 1617 nt, Artificial Sequence
  derived and/or modified sequence opt3 from VP1__Norovirus_and/or_Norovirus-like__KX514311
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaauucccgcuuuccaauaaaccuggaaagacuuuucacgggucccucaagugccaaugugguucagccucagaacgggagguguaugauugauggcguguugcugggaacuacccaacuaagcccagucaauaucugcacauuccggggcgacgugacucauccgggugggucuaagauuuacaccaugaaccucgcgucccccaauuggaacaauuaugauccuacagaggagaucccagcaccccugggaaccccugacuuuguaggcaaaauccagggcaugcuuacgcagacuacaaagggggaaggaucaacccgcggucaccgagccacuguuuacgugggcagcgcuaacuacgccccaaagcuggggagaguccaguucgagacagacaccacggaugacuuggaugcucaucaaaauaccaaauuuacacccgugggagucgugcagggcggugaaaguccgaaggggucugagccucagcaauggguucucccauccuauagcggcagggacacucccaacgugcaccuggccccugcaguagcccccaccuucccaggagaacaguuacuguuuuuccggucgacaauuccuggcugugggggacaccccaauaugaaccucgauugccuucugccacaggaguggguccagcauuuuuaccaagaggcugcgccggcacagucugacguggccuugcuacguuucguuaauccugauacuucccgcgugcuguuugaauguaaacuccacaagucagguuaugucaccguggcucauacaggccagcacgaccugguaauacccccaaacggguacuucagauuugauaguugggugaaccaguucuauacccuugcccccaugggaaauggcacugguaggaaacgguga

SEQ ID NO: 21400 - RNA, 1617 nt, Artificial Sequence
  derived and/or modified sequence opt3 from VP1__Norovirus_and/or_Norovirus-like__KX514266
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccaggcgacucuccgauuuacaccaugaaucucgcaucccccaacuggaauaacuaugacccuacagaggagaucccagcuccccuggguaccccugauuucguugggaagauucagggaaugcuuacgcagacuacaaagggcgaaggcucaacccgggggcaccgcgccacuguguacgucggaagcgcuaauuacgccccaaagcugggucgagugcaguuugagacagacaccacgaacgauuuggacgcacaucaaaauaccaaauucacacccgucggcgugguucaagggggagaaaguccgaagggcucugagccucagcagugggugcucccauccuauagcgguagagauacucccaacguacaccuggccccugcugucgcgcccaccuuuccaggggaacaguuacuguucuuuaggucgacaaucccuggcuguggaggccaccccaauaugaaccucgacugccuucugccacaggagugggugcagcauuucuaccaagaggcagccccggcucagucugauguugccuugcuacgguuugugaauccugacacuucccguguccuguucgaauguaaacuccacaagucaggguaugugaccguagcacauacaggacagcacgaucuggugauucccccaaacgguuacuuucgcuucgacaguuggguuaaccaguuuuauacccuugcccccaugggcaaugggacuggaagaaaaagguga

SEQ ID NO: 21401 - RNA, 1617 nt, Artificial Sequence
  derived and/or modified sequence opt3 from VP1__Norovirus_and/or_Norovirus-like__KX514235
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgucagacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggagcaaaccauucuccgugccugucuuaaccguggaggaaaugacuaauucacgcuuucccgccacacuggauaaacuuuucaccggaccaaguagcacguucguugugcagccccagaacgguagauguaugaucgacggcgucuugcuggggacuacccaacuaucuccugugaauauaugcacauuuaggggagauguaacucauccacgggacuccccgauuuacaccaugaaccucgcaucacccaauuggaacaauuaugacccuacagaggagaucccagcuccccugggcaccccugauuucguugguaagauucaggggaugcuuacgcagacuacaaagggagaaggcagcacccgcggccaccgagccacuguguacgucgggagugcuaacuacgccccaaagcugggaagagugcaguuugagacagacaccacgaaugauuuggacgcacaucaaaacaccaaauucacacccgucggugugguucagggcggggaaucuccgcagagguccgagccucaacagugggugcucccaagcuauucgggacgggauacucccaauguacaccuggccccugcugucgcgcccaccuuuccaggcgaacaguuacuguucuuucguucuacaaucccugguugugggggccaccccaacaugaaucucgacugccuucugccacaggagugggugcaacauuucuaccaggaggcagccccggcucaguccgauguugccuugcuacgcuuugugaacccugacacuucaagaguccuguucgaauguaagcuccacaaaaguggauaugugaccguagcacauacaggccagcacgaucuggugauucccccaaauggguacuuuagguucgacagcuggguuaaccaauuuuauacccuugcccccaugggaaacgguacuggccggaagcgauga

SEQ ID NO: 21402 - RNA, 1617 nt, Artificial Sequence
  derived and/or modified sequence opt3 from VP1__Norovirus_and/or_Norovirus-like__KX354115
augaagauggccagcuccgacgcuaaccccucugauggcucagcagccaaucuggugccugaggcgaacaaugaagucauggcucucgagccaguugccggggcagcccuugcugcaccgguggccggacagcaaaacguaaucgaccccuggauuagaaauaacuucgugcaggcuccugguggcgaauuuaccauaaguccaaggaaugcccccggggagauccuguggagcgcgccuuugggaccagauuuaaaccccuaccugucccaccuagcacggauguauaauggcuacgccgguggguucgaaguccaggugauucucgcuggaaacgccuuuacagcaggcaaaguuaucuucgcugccgugccuccaaauuuuccgacuucuggccugucgcccucacaggucacgauguucccuagcgugguaguugacgugcgccaacuugagccaguccugauucccuugccugaugugcgaaacaauuuuuaucauuacaaccagaguaaugacccaaccaucacacucauagcgaugcuguauacuccccugcgugccaacaacgcaggggaugacguguucaccgucuccugcagaguucucacaaggccgucuccugauuuugacuucaucuuuuuagugcccccaaccguagagagccggacuaagccuuucuccgugcccguccugacaguggaagagaugaccaauucacgcuuuccaauuccccuugaaagauuguucacgggaccuaguagcgcuuucguugugcagccacagaacgguagguguacuaccgauggcguccugcuagggacaacucaacucucuccggugaauaucugcaccuuucggggagacauuauccacauaacaggcucccauaacuacaccaugaaucuggccucacagaacuggaauaacuaugaucccacggaggagauuccugcuccacuugguacucccgacuucguagggaaaauccagggaguucugacacagaccacucgcggcgacggcagcacacgagggcacaaggccaccguguacacgggaagugcagauuuuauuccuaaauuggguagaguccaauucgaaaccgacacaaaucaugauuuugaggccaaccagaauacuaaguucaccccagugggcgucauccaggacgggucuacaacucacaggaacgaaccccaacagugggugcucccguccuacagcggacggaauacccacaacguucaucuggcuccugcgguggcaccaacauuucccggcgagcaguuacuguucuuucguucgaccaugccugguuguucuggguaucccaauauggaucucgacugccuucugccacaggaauggguacaauacuucuaucaggaggccgcuccugcccaguccgaugucgcauugcuacgcuuugugaaccccgacacuggcagaguucuguucgaguguaagcuccacaaaucaggauacaucacgguggcccauacaggccagcacgaucuggucauuccaccgaacggguauuuuagguucgacaguugggugaaucaauucuacacccuugcuccuaugggaaacgguacuggccggcgacgcuga

SEQ ID NO: 21403 - RNA, 1617 nt, Artificial Sequence
  derived and/or modified sequence opt3 from VP1__Norovirus_and/or_Norovirus-like__KM272334
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggacauauaauggcuacgcggguggguucgaagugcaggucauucuagcaggaaacgccuuuacugcuggcaaagugaucuucgccgcaguaccuccaaauuuuccgacggagggccucucucccucgcagguuaccauguucccucauauuguggucgacgcucgccaacuggagccagugcuuaucccccugccugaugugcgaaacaauuuuuaucacuacaaccagucaaaugacccaacaauaaaguugaucgccaugcucuauacuccccugcgugcgaacaacgccggggaugacgucuucaccguuagcugcagagugcugacaaggccgaguccugauuuugacuucauuuuucucguacccccaaccguggaaucccggacuaaaccuuucucuguccccguguuaacaguugaggaaaugaccaauagccgcuuuccaaucccccuggagaaacuuuucacgggaccuuccucagcauucgugguccagccacagaacaguagauguacuaccgaugguguguugcugggcacaacucaacuaagcccgguaaauauuugcaccuuuaggggagacguuacacauaucaccgggucucggaacuacacgaugaaucucgcuucccagaacuggaauaacuaugaucccacugaggaaauaccugugccacugggcacacccgacuucgucgguaagauucagggggugcuuacccagacuacacgcaccgacggaucaacgcgaggccacaaggccaccgucuacacaggcagcgcugauuuugccccuaagcuggggagagugcaauucgagacugacaccgaucaugacuuugaagcaaaucagaacacaaaauucacuccaguuggagugauccaggaugguggcaccacacacaggaaugagccccaacaguggguauugccgaguuacucugggcggaacacccacaauguccaucucgccccugcuguggcgccaacuuuucccggagaacagcuguuauucuuucguuccacgaugccuggcuguagcgguuaucccaacauggaccuggauugccuccuuccacaggaguggguucaauacuucuaucagggggcagccccugcucagucggacguggcccuguugcgcuuugucaaucccgauacaggcagagugcuauucgaguguaagcugcacaaaucuggauacguaaccguggcacauacuggccagcacgaccucguuauuccaccgaacggguauuuuagguucgauuccugggucaaccaauucuacacccuggccccuaugggaaaugguacaggccggcgacgcuga

SEQ ID NO: 21404 - RNA, 1617 nt, Artificial Sequence
  derived and/or modified sequence opt3 from VP1__Norovirus_and/or_Norovirus-like__KX354116
augaagauggccagcuccgacgcuaaccccucugauggcucagcagccaaucuggugccugaggcgaacaaugaagucauggcucucgagccaguugccggggcagcccuugcugcaccgguggccggacagcaaaacguaaucgaccccuggauuagaaauaacuucgugcaggcuccugguggcgaauuuaccauaaguccaaggaaugcccccggggagauccuguggagcgcgccuuugggaccagauuuaaaccccuaccugucccaccuagcacggauguauaauggcuacgccgguggguucgaaguccaggugauucucgcuggaaacgccuuuacagcaggcaaaguuaucuucgcugccgugccuccaaauuuuccgacugcgggccugucucccucgcaggucacgauguucccuucagugguaguugacgugcgccaacuugagccaguccugauucccuugccugaugugcgaaacaauuuuuaucauuacaaccagagcaaugacccaaccaucacacucauagccaugcuguauacuccccugcgugcaaacaacgcuggggaugacguguucaccgucaguugcagaguucucacaaggccguccccugauuuugacuucaucuuuuuagugcccccaaccguagagucucggacuaagccuuucagcgugcccguccugacaguggaagagaugaccaauucccgcuuuccaauuccccuugaaagauuguucacgggaccuucaagugccuucguugugcagccacagaacgguagguguacuaccgauggcguccugcuagggacaacucaacucagcccggugaauaucugcaccuuucggggagacauuauccacauaacaggcucucauaacuacaccaugaaucuggcuucccagaacuggaauaacuaugaucccacggaggagauuccugccccacuugguacucccgacuucguagggaaaauccagggaguucugacacagaccacucgcggcgacggcucaacacgagggcacaaggcaaccguguacacgggaagcgccgauuuuauuccuaaauuggguagaguccaauucgaaaccgacacaaaucaugauuuugaggcuaaccagaauacuaaguucaccccagugggcgucauccaggacgggaguacaacucacaggaacgaaccccaacagugggugcucccgucuuacuccggacggaauacccacaacguucaucuggcgccugcaguggccccaacauuucccggcgagcaguuacuguucuuucguagcaccaugccugguuguucgggguaucccaauauggaucucgacugccuucugccacaggaauggguacaauacuucuaucaggaggcugccccugcacagucugaugucgccuugcuacgcuuugugaaccccgacacuggcagaguucuguucgaguguaagcuccacaaauccggauacaucacgguggcucauacaggccagcacgaucuggucauuccaccgaacggguauuuuagguucgacucaugggugaaucaauucuacacccuugccccuaugggaaacgguacuggccggcgacgcuga

SEQ ID NO: 21405 - RNA, 1617 nt, Artificial Sequence
  derived and/or modified sequence opt3 from VP1__Norovirus_and/or_Norovirus-like__KX514172
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaacgcgggggaugacguguucaccgucaguugcagaguucugacaaggcccuccccggauuuugacuucauuuuucucgugccucccaccguagaaucucggagcaaaccauucuccgugccugucuuaacuguggaggaaaugacaaacucacgcuuucccgccacccuggauaaacuuuucacgggaccaaguagcacuuucguugugcagccccagaaugguagauguaugaucgacggcgucuugcuggggaccacacaacuaucuccugugaacauaugcacuuuuaggggagauguaacccauccacgggacucccagauuuacacaaugaaucucgcaucaccgaacuggaauaacuaugaccccaccgaggagaucccugcuccacugggcacgcccgauuucguugguaagauucaggggaugcuuacucagacaaccaagggagaaggcagcacucgcggccaccgagccacaguguacgucgggagugcuaauuacgccccuaagcugggaagagugcaauuugagaccgacacgaccaacgauuuggacgcacaucagaauacaaaauucacuccagucggugugguucagggcggggaaucucccaagggauccgagccgcaacagugggugcucccuagcuauucgggcagggauaccccaaacguacaccuggcccccgcugucgcgccuacauuucccggugaacaguuacuguucuuucggucuacuaucccaggguguggcggacacccuaauaugaaccucgacugccuucugccccaggagugggugcaacauuucuaccaggaggcagccccagcucaguccgauguugccuugcuacguuuugugaauccggacaccucacgcguccuguucgaauguaaacuccacaagaguggcuaugugacaguagcacauaccgggcagcacgaucuggugaucccucccaacggauacuuuagauucgacagcuggguuaaucaauuuuauacucuugccccaauggguaacggcacggggaggaaacgguga

SEQ ID NO: 21406 - RNA, 1617 nt, Artificial Sequence
  derived and/or modified sequence opt3 from VP1__Norovirus_and/or_Norovirus-like__KX354114
augaagauggccagcuccgacgcuaaccccucugauggcucagcagccaaucuggugccugaggcgaacaaugaagucauggcucucgagccaguugccggggcagcccuugcugcaccgguggccggacagcaaaacguaaucgaccccuggauuagaaauaacuucgugcaggcuccugguggcgaauuuaccauaaguccaaggaaugcccccggggagauccuguggagcgcgccuuugggaccagauuuaaaccccuaccugucccaccuagcacggauguauaauggcuacgccgguggguucgaaguccaggugauucucgcuggaaacgccuuuacagcaggcaaaguuaucuucgcugccgugccuccaaauuuuccgacuucuggccugucgcccucacaggucacgauguucccuagcgugguaguugacgugcgccaacuugagccaguccugauucccuugccugaugugcgaaacaauuuuuaucauuacaaccagaguaaugacccaaccaucacacucauagcgaugcuguauacuccccugcgugccaacaacgcaggggaugacguguucaccgucuccugcagaguucucacaaggccgucuccugauuuugacuucaucuuuuuagugcccccaaccguagagagccggacuaagccuuucuccgugcccguccugacaguggaagagaugaccaauucacgcuuuccaauuccccuugaaagauuguucacgggaccuaguagcgcuuucguugugcagccacagaacgguagguguacuaccgauggcguccugcuagggacaacucaacucucuccggugaauaucugcaccuuucggggagacauuauccacauaacaggcucccauaacuacaccaugaaucuggccucacagaacuggaauaacuaugaucccacggaggagauuccugcuccacuugguacucccgacuucguagggaaaauccagggaguucugacacagaccacucgcggcgacggcagcacacgagggcacaaggccaccguguacacgggaagugcagauuuuauuccuaaauuggguagaguccaauucgaaaccgacacaaaucaugauuuugaggccaaccagaauacuaaguucaccccagugggcgucauccaggacgggucuacaacucacaggaacgaaccccaacagugggugcucccguccuacagcggacggaauacccacaacguucaucuggcuccugcgguggcaccaacauuucccggcgagcaguuacuguucuuucguucgaccaugccugguuguucuggguaucccaauauggaucucgacugccuucugccacaggaauggguacaauacuucuaucaggaggccgcuccugcccaguccgaugucgcauugcuacgcuuugugaaccccgacacuggcagaguucuguucgaguguaagcuccacaaaucaggauacaucacgguggcccauacaggccagcacgaucuggucauuccaccgaacggguauuuuagguucgacaguugggugaaucaauucuacacccuugcuccuaugggaaacgguacuggccggaagcgauga

SEQ ID NO: 21407 - RNA, 1617 nt, Artificial Sequence
  derived and/or modified sequence opt3 from VP1__Norovirus_and/or_Norovirus-like__KX514295
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucaaccccucccagguaaccauguucccucauaucauaguugacgugcgccaacuggagccaguccuuaucccccugccugaugugcgaaauaacuuuuaucacuacaaucagucuaacgacucgacaauuaaguugaucgcuaugcucuauacuccacugcgugccaacaaugcgggggaugacguguucaccgucucaugcagaguucugacaaggcccagcccggauuuugacuucauuuuucucgugccucccaccguagaaagucgguccaaaccauucucugugccugucuuaacuguggaggaaaugacaaacagccgcuuucccgccacccuggauaaacuuuucacgggaccauccucaacuuucguugugcagccccagaaugguagauguaugaucgacggcgucuugcuggggaccacacaacuaaguccugugaacauaugcacuuuuaggggagauguaacccauccacgggacagcccgauuuacacaaugaaucucgcaucucccaacuggaauaacuaugacccuaccgaggagaucccagcuccccugggcacgccugauuucguugguaagauucaggggaugcuuacucagacaaccaagggagaaggcuccacucgcggccaccgagccacaguguacgucgggucagcuaauuacgccccaaagcugggaagagugcaguuugagaccgacacgaccaacgauuuggacgcacaucaaaauacaaaauucacucccgucggugugguucagggcggggaaagcccgaagggaagugagccucagcaaugggugcucccaucuuauuccggcagggauacccccaacguacaccuggccccugcugucgcgcccacauuuccaggugaacaguuacuguucuuucggagcacuaucccuggguguggcggacaccccaauaugaaccucgacugccuucugccacaggagugggugcagcauuucuaccaagaggcagccccggcucagucggauguugccuugcuacguuuugugaauccugacaccucucgcguccuguucgaauguaaacuccacaaguccggcuaugugacaguagcacauaccgggcagcacgaucuggugauucccccaaacggauacuuuagauucgacucauggguuaaccaguuuuauacucuugcccccauggguaauggcacggggaggaaacgguga

SEQ ID NO: 21408 - RNA, 1617 nt, Artificial Sequence
  derived and/or modified sequence opt3 from VP1__Norovirus_and/or_Norovirus-like__KX514242
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggagcaaaccauucuccgugccugucuuaaccguggaggaaaugacuaauucacgcuuucccgccacacuggauaaacuuuucaccggaccaaguagcacguucguugugcagccccagaacgguagauguaugaucgacggcgucuugcuggggacuacccaacuaucuccugugaauauaugcacauuuaggggagauguaacucauccacgggacuccccgauuuacaccaugaaccucgcaucacccaauuggaacaauuaugacccuacagaggagaucccagcuccccugggcaccccugauuucguugguaagauucaggggaugcuuacgcagacuacaaagggagaaggcagcacccgcggccaccgagccacuguguacgucgggagugcuaacuacgccccaaagcugggaagagugcaguuugagacagacaccacgaaugauuuggacgcacaucaaaacaccaaauucacacccgucggugugguucagggcggggaaucuccgcagagguccgagccucaacagugggugcucccaagcuauucgggacgggauacucccaauguacaccuggccccugcugucgcgcccaccuuuccaggcgaacaguuacuguucuuucguucuacaaucccugguugugggggccaccccaacauggaccucgauugccuucugccacaggagugggugcaacauuucuaccaggaggcagccccggcucaguccgacguugccuugcuacgcuuugugaauccugauacuucaagaguccuguucgaauguaagcuccacaaaaguggauaugugaccguagcacauacaggccagcacgaccuggugauucccccaaacggguacuuuagguucgauagcuggguuaaucaauuuuauacccuugcccccaugggaaacgguacuggccggaagcgauga

SEQ ID NO: 21409 - RNA, 1617 nt, Artificial Sequence
  derived and/or modified sequence opt3 from VP1__Norovirus_and/or_Norovirus-like__KX514224
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaauguguuuacagccggcaaaaucauuuucgcugccguaccuccaaacuuuccgacugagggccucucccccucucagguuacgauguucccucauaucauaguggacguccgccaacuggagccagugcuuaucccccugccugaugugcgaaauaacuuuuaucacuacaaucagucgaacgacucaaccauuaaguugaucgcaaugcucuauacaccacugcgugcuaacaaugccggggaugacgucuucacuguuagcugcagagugcugaccaggcccaguccggauuuugacuucauuuuucucguaccucccacaguggaaucccggucuaaaccauucagcgucccuguguuaaccguugaggaaaugacuaacucccgcuuucccgcgacacuggauaaacuuuucaccggaccaucaaguacguucgugguccagccccagaaugguagauguaugaucgacggcguguugcuggggacuacccaacuaagcccuguaaacauaugcacauuuaggggagauguuacucauccacgggacucuccgauuuacaccaugaaucucgccucccccaacuggaauaacuaugacccuacagaggagaucccagcaccccugggcaccccugauuucguggguaagauucaggggaugcuuacgcagacuacaaagggagaaggcucaacccgcggccaccgagcuacugucuacguggggagcgccaauuacgcuccaaagcugggaagaguccaguuugagacagacaccacgaacgauuuggacgcccaucaaaauaccaaauucacacccguggguguugugcagggcggggaaaguccgcagaggucugagccucaacaguggguacucccauccuauagcggacgggauacucccaacguccaccuggcacccgccguggcucccaccuuuccaggcgaacaguuacuguucuuucguucgacaaucccugguugugggggccaccccaauaugaaccucgacugccuucugccacaggaguggguucaacauuucuaccaggaggcggcaccggcccagucugauguggcuuugcuacgcuuugucaauccugacacuuccagagugcuguucgaauguaagcuccacaaaucaggauauguaaccguggcccauacaggccagcacgaucugguuaucccuccaaacggguacuuuagguucgacaguugggucaaccaauuuuauacccuugcacccaugggaaaugguacuggccggaagcgauga

SEQ ID NO: 21410 - RNA, 1617 nt, Artificial Sequence
  derived and/or modified sequence opt3 from VP1__Norovirus_and/or_Norovirus-like__KX514262
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaacgcgggggaugacguguucaccgucaguugcagaguucugacaaggcccuccccggauuuugacuucauuuuucucgugccucccaccguagaaucucggagcaaaccauucuccgugccugucuuaacuguggaggaaaugacaaacucacgcuuucccgccacccuggauaaacuuuucacgggaccaaguagcgcauucguugugcagccccagaaugguagauguaugaucgacggcgucuugcuggggacuacccaacuaucuccugugaacauaugcacauuuaggggagauguaacucauccacgggacuccccgauuuacaccaugaaucucgcuucacccaacuggaauaacuaugacccuacagaggagaucccagcuccccugggcaccccugauuucguugguaagauucaggggaugcuuacgcagacuacaaagggagaaggcagcacccgcggccaccgagccacuguguacgucgggagugccaauuacgcaccaaagcugggaagagugcaguuugagacagacaccacgaacgauuuggacgcccaucaaaauaccaaauucacacccgucggugugguucagggcggggaaucuccgaagggauccgagccucagcaaugggugcucccaagcuauucgggcagggauacucccaacguacaccuggcuccugcggucgcacccaccuuuccaggugaacaguuacuguucuuucggucuacaaucccuggguguggcggacaccccaauaugaaccucgacugccuucugccacaggagugggugcagcauuucuaccaagaggccgcuccggcccaguccgauguugcauugcuacguuuugugaauccugacacuucacgcguccuguucgaauguaaacuccacaagaguggcuaugugaccguagcccauacagggcagcacgaucuggugauucccccaaacggauacuuuagauucgacagcuggguuaaucaguuuuauacccuugcucccauggguaacggcacugggaggaaacgguga

SEQ ID NO: 21411 - RNA, 1617 nt, Artificial Sequence
  derived and/or modified sequence opt3 from VP1__Norovirus_and/or_Norovirus-like__KX354139
augaagauggccagcuccgacgcuaaccccucugauggcucagcagccaaucuggugccugaggcgaacaaugaagucauggcucucgagccaguugccggggcagcccuugcugcaccgguggccggacagcaaaacguaaucgaccccuggauuagaaauaacuucgugcaggcuccugguggcgaauuuaccauaaguccaaggaaugcccccggggagauccuguggagcgcgccuuugggaccagauuuaaaccccuaccugucccaccuagcacggauguauaauggcuacgccgguggguucgaaguccaggugauucucgcuggaaacgccuuuacagcaggcaaaguuaucuucgcugccgugccuccaaauuuuccgacuacgggccugucucccucgcaggucaccauguucccuucagugguaguugacgugcgccaacuugagccagucaugauuccccugccugaugugcgaaacaauuuuuaucauuacaaccagagcaaugacccaacaaucacuuugauagcgaugcucuauacgccccugcgugccaacaacgcaggggaugacguguucacagucaguugcagaguucugaccaggccguccccugauuuugacuucaucuuucucgugcccccaacuguagagucucggacaaagccuuucagcgugcccgucuuaaccguggaagagaugaccaauucccgcuuuccaauuccccuggaaagacuuuucacuggaccuucaagugcuuucguugugcagccacagaacgguagguguaccacagauggcgucuugcuggggacuacccaacuaagcccggugaauaucugcacauuucggggagacguaacccacauuacgggcucucgcaacuacacuaugaaucucgccucccagaacuggaauaacuaugaucccacagaggagaucccugcuccacuggguacccccgacuucguugggaaaauacagggaaugcuuacucagacaacccgaacggacggcucaaccagaggccauaaggccacaguguacacugggagcgcagauuuugccccuaaacugggaaggguccaauucgaaaccgacacagaucacgacuuugaggcuaaucagaacacuaaguucaccccagugggugucauucaggauggcaguacaacccaucggaaugaaccccaacaguggguguugccgucuuacuccgggcguaacacucacaauguucaccucgcgccugcaguggccccaacguuucccggagagcagguaaucuucauucgcagcacaaugccuggcucgucugguuaucccaacauggaccuggauuguuuacugccacaggaauggguccaauacuuuuaucaggaggcugccccugcacaguccgacguggccaugaucagauucguuaaucccgauaccgggagggugcucuuugagugcaaacuucauaagucaggcuacaucacugucgcucacaccggacagcaugaccuggugauuccaccgaacggcuauuuccgguuugauaguuggguaaaccaauucuacacauuggccccuauggggaauggaaccggucgacgcagauga

SEQ ID NO: 21412 - RNA, 1617 nt, Artificial Sequence
  derived and/or modified sequence opt3 from VP1__Norovirus_and/or_Norovirus-like__KX514215
augaagauggccagcaacgacgugaaucccuccgauggcucuaccgcuaaccuggucccugagguuaauaacgaagugauggcacucgagccaguagugggggccgcgaucgcugccccggucgcaggacagcaaaaugugaucgaccccuggauaagaaacaauuucguucaggccccugguggcgaauuuacagugucaccaaggaacgcucccggggagauccuuuggagugcaccucugggaccaggcuugaaucccuacuuaagccaccuggcccggauguauaacgguuacgcugggggauucgaaguccaggugauucuagccggcaaugcguuuacugcaggcaaaaucauuuucgccgcuguaccuccaaacuuuccgacggaggggcucaaucccucccagguuaccauguucccucauaucauaguggauguccgccaacuggagccagugcuuaucccccugccugacgugcgaaacaauuuuuaucacuacaaccagucuaacgauucgacaauuaaguugaucgccaugcucuauacuccacugcgugcaaauaacgcuggagacgaugucuucaccguuucaugcagagugcugacaaggcccagcccggacuuugauuucauuuuucucguaccucccaccguggaaagucgguccaaaccauucucugucccuguguuaacuguucaggagaugacaaauagccgcuuucccgccacccuggacaaacuuuucacggguccauccucaacuuucgugguccagccccaaaacggcagauguaugaucgaugggguguugcugggaaccacacagcuaaguccuguaaauauaugcacuuuuaggggcgacguuacccauccacgggauagcccgauuuacacaaugaaccucgcgucucccaauuggaacaauuaugacccuaccgaagagaucccagcaccccuggguacgccugacuucguggggaagauucagggaaugcuuacucagacaaccaagggcgagggcuccacucgcgggcaccgagccacagucuacgugggaucagcuaacuacgccccaaagcuggguagaguccaauuugaaaccgauacgaccaaugacuuggaugcucaucagaacacaaaauucacucccgugggcguugugcaagggggagagagcccgcagaggagugaaccucagcaguggguacucccaucuuauuccggccgggacacccccaauguccaccuggccccugcaguggcccccacauuuccaggugagcaguuacuguucuuucguagcacuaucccuggguguggcggacaccccaacaugaaucucgauugccuucugccacaagaauggguucagcauuucuaccaggaggcugcgccggcacagucggacguggccuugcuacgcuuugucaacccugauaccucuagagugcuguucgaguguaagcuccacaaauccggcuauguaacaguggcucauaccgggcaacacgaccugguuauucccccaaacggauacuuuagguucgauucaugggucaaucaguuuuauacucuugcccccauggguaacggcacggggcggaagcgauga

SEQ ID NO: 21413 - RNA, 1617 nt, Artificial Sequence
  derived and/or modified sequence opt3 from VP1__Norovirus_and/or_Norovirus-like__KX514367
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaacgccggggaugacguguucacagucaguugcagaguucugaccaggcccuccccggauuuugacuucauuuuucucgugccucccacuguagaaucucggagcaaaccauucuccgugccugucuuaacaguggaggaaaugaccaacucacgcuuucccgcgacgcuggauaaacuuuucacuggaccaaguagcaccuucguugugcagccccagaaugguagauguaugaucgacggcgucuugcuggggacaacucaacuaucuccugugaacauaugcaccuuuaggggagauguaacacauccacgggacuccccgauuuacaccaugaaucucgccucacccaacuggaauaacuaugacccuacggaggagaucccagcaccccugggcacuccugauuucguugguaagauucaggggaugcuuacacagaccacuaagggagaaggcagcacacgcggccaccgagcuaccguguacgucgggagugccgacuacgcuccaaagcugggaagagugcaguuugagacggauaccacaaaugacuuggaugcccaucaaaacacuaaauucacccccgucggugugguucagggcggggaaucuccgaagggauccgagccucagcaaugggugcucccaagccacucgggcagggacacacccaauguacaccuggcacccgccgucgcucccacuuuuccaggugaacaguuacuguucuuucggucuaccaucccuggguguggcggacaucccaacaugaaucucgauugccuucugccacaggagugggugcagcacuucuaucaagaggcggcaccggcccaguccgacguugcuuugcuacguuuugugaacccugauacaucacgcguccuguucgaauguaaacuccauaagaguggcuacgugaccguagcccacacugggcagcacgaccuggugaucccuccaaauggauauuuuagauucgauagcuggguuaaccaguuuuacacgcuugcacccauggguaauggcacagggaggaaacgguga

SEQ ID NO: 21414 - RNA, 1617 nt, Artificial Sequence
  derived and/or modified sequence opt3 from VP1__Norovirus_and/or_Norovirus-like__KX514243
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaacgcgggggaugacguguucaccgucagcugcagaguucugacaaggcccaguccggauuuugacuucauuuuucucgugccucccaccguagaaucccggucuaaaccauucagcgugccugucuuaacuguggaggaaaugacaaauucccgcuuucccgccacccuggauaagcuguucacgggaccaucaaguaacuugguugugcagccccagaaugguagauguaugaucgacggcguccugcuagggacuacccaacucagcccugugaacauaugcacauucaggggagauguaacucauccacgggacucuccgauuuacaccaugaaucuggcaucccccaacuggaacucauaugacccuacagaggagaccccagcuccccuuggcacgccugauuuuguugguaaaauccacgggaugcugacucagacaacccagggaagcggcaguacucgcgcccaucgagcuacaguguacgucggcggggccgaguucaccccaaaguugggaaaggugcaguuuaaaacggaaaccgaccacgaucucucuauuagacaaaauacaaaguucacucccgucggugugguucagggcggggaauccccgcagaggagcgagccucaacagugggugcugccaucguacucuggacgggacacccccaauguacacuuagcacccgccgucgcucccacauuuccaggcgaacagcuucucuucuuucguuccacuaucccugguugugggggccaucccaacaugaaucuugauugccuguugccacaggagugggugcaacacuucuaucaggaggcggcaccggcccagucagacguugcucuacugcgcuuugugaacccugauaccaguagaguccucuucgaauguaaacugcauaagagcggauacgugacaguagcccacaccggccagcacgaccuugugaucccuccaaauggguauuuuagguucgauuccuggguuaaccaauuuuacacucuggcacccaugggaaaugguacgggccggaaacgauga

SEQ ID NO: 21415 - RNA, 1617 nt, Artificial Sequence
  derived and/or modified sequence opt3 from VP1__Norovirus_and/or_Norovirus-like__KX353996
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauacccauaacgugcaccucgccccagcaguagcccccacuuuuccuggagagcagcuguuauucuuucguucuacgaugcccggcuguuccgguuauccaaauauggaucuggaccgccucccuccccaggaaagaguccaauacuucuaucaggaggcugcgccagcacagucagauguggcccuucugagguuuguuaacccggacacagggcggguguuguucgagugcaagcuacacaaaaguggcuacgucaccguggcucauacuggacagcacgaucugguaaucccucccaacggcuauuuucgauucgacagcugggugaaucaauucuacacccucgccccaauggggaacggaacaggucgcagaagguga

SEQ ID NO: 21416 - RNA, 1617 nt, Artificial Sequence
  derived and/or modified sequence opt3 from VP1__Norovirus_and/or_Norovirus-like__DQ078820
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucgggcccucucagguaaccauguucccucauaucauaguugacgugcgccaacuggagccaguccuuaucccccuguuggaugugcgaaacaaucucuaucacuacaaccagucgaaugacccuacaauuaagcugaucgcaaugcuguauacuccacuccgugcuaacaacgccggagaaguggucuuuaccguuucaugcagaguguuaacaaggcccagcccggauuucgacuuuauuuuccugguaccucccaccguggagagucggacuaaaccauuuacagucccuauccuuaccgcggaagagaugacuaauucccgcuuccccacgccauuggguaagcuguuuaccggccccucuagcgccuucgugguucagccucagaacgggagaugugcaacagauggagugcuacucggcacuacccaacuguccccagucaauauaugcacauucaggggugacgugacccauauugcugggacgcacgauuacacuaugaaccuugccucacagaauuggaacaauuaugacccgacagaggaaauccccgcuccucugggaaccccagauuuuguaggcaaaauucagggcguuuugacucagacaacccgcggggacggaaguacgcggggucauaaggccaccgugagcacaggcucuguccacuucacucccaagcucgggggagugcaauuuaccacagacacuaacaaugauuucgagaccggccagaacacaaaauuuaccccugucggugugauccaggacggcaauuccacucaccaaaacgaaccacagcaguggguucugcccaauuacucagggcgaacgggacauaacgugcacuuagcaccggccguagcuccuacauucccaggcgagcagcugcucuuuuucagaagcaccaugcccggguguaguggauacccuaauaugaaccuugauugccuguugccccaagaauggguccagcauuuuuaucaggaggcggcaccagcccagucugacguggcucuacugagguucguuaacccugaugccggucgggugcucuuugaguguaagccccacaaauccggcuacgucacuguggcacacaccgggcaacaugaccugguaaucccaccgaauggauauuuccguuuugauagcugggugaaccaguucugcacacuugccccuaugggcaaugguaccgggcgcagaagguga

SEQ ID NO: 21417 - RNA, 1617 nt, Artificial Sequence
  derived and/or modified sequence opt3 from VP1__Norovirus_and/or_Norovirus-like__AB933738
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuauucccucuggcucggaaagugaagggcuaugccgguggguuugaaguccaggugauucuagcgggaaaagcauucccagccggcaagaucauuuuugcugccagcccgcccaacuucccuacugagggccucuccccaucucagguaacgauguuuccccacaucauaguugacgugcgccaacuggagccuguccuuaucccacugcccgaugugcgaaauaacuucuaccauuauaaucagucgaacgacucaaccauuaaauugaucgcaaugcucuacacaccgcugcgugcuaauaacgccggggaagauguguuuacugucagcugcagaguucugaccaggccuagucccgacuucgauuuuauuuuccucgugccaccuacaguagagucccggaccaagcccuuuucugugccaaucuuaacugucgaagagaugacaaacagccgcuuccccauaccucuggagaaacuuuucaccggaccauccucaacguuugugguucagccgcagaaugguagauguacuaccgacggcguguugcuggggacaacucaacuaagucccgucaacauuugcaccuucaggggagaugugacacacaucgcgggcagccggaauuauaccaugaaccucgccucucagaauuggaacuccuacgacccuacggaagagauuccagcaccccuggguacuccugauuuuguagggaagauccagggaguucuuacacagaccacucgccgagacggcucaacaagaggccauaaggcuaccguguauacggggagcgccgacuucaguccaaaacugggaaggguccaauuugcuaccgauacagacaaugauuucgacacucaccagaacaccaaguuuacacccgugggugucauccaggauggcgggacugcccaucggaaugaaccgcaacaguggguguugccuucuuacuccggacguaacacccacaauguucaccucgcaccagccguggcucccacauucccuggcgagcagcuguuauuuuuccgcagcaccaugcccgguuguucgggguacccaaacauggaccuggauugccuccuuccucaggaauggguacaauauuuuuaccaggaggcggcacccgcccagucugacgucgcucuguugagauucgugaauccagauacuggcaggguucuauuugaguguaaacugcauaaguccggauaugugacggucgcccacacaggccagcaugaccucgugauuccgccuaacggguacuuccgguucgauucauggguaaaucaauuuuauacccuggcacccaugggaaacgguacuggccgacgcagauga

SEQ ID NO: 21418 - RNA, 1617 nt, Artificial Sequence
  derived and/or modified sequence opt3 from VP1__Norovirus_and/or_Norovirus-like__EU780734
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaagcuguucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaaaauccagggaguucuuacucaaacaacccggcgcgacggcagcacgcgaggccacaaggccaccgugucuacaggguccauccauuuuacucagucaugggcugucuucaauagcccucugauucaggccaugaccuugaagcucgcaaaaacaagagauaguccacaaucuguggucgugcaggacggauccacuacccaccagaacgagccccagcaauggguucugccggauuacagcgguagggacucguacaaugugcacuuagccccugcuguagcgccaacauuucccggcgaacagcuucucuucuuucggucuaccaugccuggguguuccggauaucccaacaugaaucuugauugccuguugccacaggaguggguccagcauuucuaccaagaaucagccccugcacagagugacguggcucuacugcguuuuguuaaccccgauacuggccgcguccucuucgaguguaagcugcacaaaagcgguuaugugacgguggcccauacagggcagcacgaccuuguaauaccaccgaauggcuacuuuagauucgauuccugggugaaccaguuuuauacccuggcaccuaugggaaacggcgccgggaggcggcgauga

SEQ ID NO: 21419 - RNA, 1617 nt, Artificial Sequence
  derived and/or modified sequence opt3 from VP1__Norovirus_and/or_Norovirus-like__KP064096
auggccagcaaggacgcucccaccaacauggauggcacauccggggcaggacagcuggugccugaggccaauacugcggaaccaaucucuauggagccggucgcuggugccguuacggcagccgcuaccgcaggccaagugaacaugauugaccccuggauaaugaauaacuacguacaggccccucagggggaguucacaaucucaccaaauaacacucccggagauauucucuuugaccuucagcugggcccucacuugaauccauucuuaagucaucuggcucaaauguauaacgguuggguggggaauaugaaagucagagugcuacucgccggaaacgcguuuaccgcaggcaagaucauuaucagcugcauacccccuggcuucguugcccagaauaucuccauugcucaggccacaauguuuccacacgugaucgcagaugucagggugcuggaaccgauugaaguaccccuugaggacguucggaacgugcuguuccauaauaacgauaauaccccuacuaugcgcuuggucuguauccucuacacaccacugcgagcuucugggucgucaagcggaaccgaccccuuugugauagccggucgugugcugacgugcccuaguccagauuucuccuuucucuucuuaguucccccgaacgucgagcagaaaacuaagccuuuuucugugcccaaccugccacuuaauaccuugagcaacuccagaguaccuucacugauuaaaaguaugauggugagcagggaccacggccaaaugguccaguuccagaaugggcgggugacacuagauggacagcuccaaggcacuacccccacaucugcgucccagcuguguaagauccgcgguucaguuuuucaugccaacgggggaaauggcuauaaccuuaccgaacuggacggcagcccauaccacgcauucgagagucccgcuccuauuggguucccagauuugggagaaugcgacuggcacauggaggccucuccgacgacucaguuuaauacaggugacgugaucaagcaaaucaacgucaaacaggaguccgcuuucgcaccccaucucggcaccauucaggccgaugggcugagcgacgugucgguaaauacuaacaugauagccaaguuaggauggguuucuccuguguccgauggccacaaaagagacgucgauccaugggugauccccagguaugguucaacacugaccgaagcugcgcagcucgcaccuccaauuuaucccccgggguuuggcgaggccaucgucuucuuuaugagugacuucccuauagcucauggaacgaauggccuuagcgugccauguaccauuccccaagaauuuguuacacacuucgugaacgagcaggccccuacucgcggggaagcagcccuguugcacuaccuagaucccgacacccaucggaaucugggagaguuuaagcucuacccagaugguuucaugacaugcguaccuaacacuuccggcaccgggccccagacacugccaaucaauggagucuuuguguucguuucuugggugagccgauuuuaccagcuuaaaccggucggcaccgcugguccugccagaaggcuguga

SEQ ID NO: 21420 - RNA, 1617 nt, Artificial Sequence
  derived and/or modified sequence opt3 from VP1__Norovirus_and/or_Norovirus-like__KC473548
augaugauggccagcaaggacgcucccaccaacauggauggcacauccggggcaggacagcuggugccugaggccaauacugcggaaccacucccgaucaaacccgucgcuggugccgcaacggccguugcuaccgcaggccaagugaacaugauugacccuuggauaaugaauaacuucguacaggccccacagggggaguuuacaaucucucccaauaacacuccuggagauauucuuuucgaccugcaguugggcccacacuuaaaucccuuucuggcucaucuaucaagaauguacaacgguuggguggggaauaugcaagucaggaucaugcucgccggaaacgcguucagugcaggcaagauuaucgugugcuguauaccuccaggcuuuagcucccagucuaucucgauugcccaggcuaccauguucccgcacguuaucgccgaugugcggguccuggaacccauugacgugccucuugaugacguacgcaauguucuguuucauaacaaugauaacccacagacaaugcgauugcucugcaugcuguauacuccccugcguucagggggaaccagcagugguacagacccuuucgugaucgcaggcagaguccucaccuguccaacgcccgauuuuuccuucuuauuucuggugccgccugacauagagcaaaggacuaaacccuucucugugccaaauauuccuaugaaccuuaugagcaacucccgggucucaauguugaucgaugggaugaugguuaguaaugaccagaaccaggugccccaguuucaaaauggacgcguaacccuggacggccagcuacaggguacaacuaccgugagcgcugccugcgucgcgagaaugagggggcggauuuucaacaauaacggaaauuacggcgugaaccucacagaacuggauggcaauccauaucacgccuucgacucucccgcaccucuuggguuuccagauuucggaaacugugaccugcauaugaccuuuguuaagaucaauccgaacgaguuguccucaggugaucccagcggcaaaguggucauccgcaguuacgacgcuacguucgccccucaccucgggacugugaagcuggagaaugaugacgaauuagcucgauuuguaggaaaggagguugugcuggaacucacaugggucucuaacagagagggcgccacccuuaaucugugggcagugccaaacuaugguuccagcuugacucaagccucgcagcuagcucccccuauuuacccacccggguucggcgaggcgauagucuauuuuacaucuaccuucccgacgguguccaacccuaaaguuccaugcacccugccccaggaauuugugucacacuucguaaaugagcaggcaccuacaaggggagaugccgcucuccugcauuacgucgaccccgauacucaccggaaccuuggcgaauuuaagauguacccagagggguauaugaccugugugccuaaugccggagguggcccccaaacacugccaaucaacgggguuuucguguuuauuaguugggucagccguuacuaucaguugaaaccggugggaacugcaggcgccgcucgcagacucuga

SEQ ID NO: 21421 - RNA, 1617 nt, Artificial Sequence
  derived and/or modified sequence opt3 from VP1__Norovirus_and/or_Norovirus-like__AB684698
auggccagcaaggacgcucccuccaacauggauggcaccucuggggcaggacagcuggugccugaggccaauacagcggaaccaaucaacauggagucagucguuggugcugccacugcaacggccaccgcuggccaagugaaucucauugacccguggauaaugaacaauuacguacaggcaccccagggggaguucacaaucaguccuaacaauacuccaggagaugugcuuuuugaccugcaguugggcccccacuuaaacccuuuccugagccaucuauccagaauguauaaugguugggucgggaacaugaaagugaggguuaugcucgccggaaaugcuuuuucugccggcaagauuaucauuugcuguaucccacccggcuucaccucgcaaucaauaagcaucgcgcaggcaacaauguuuccucacgugauugccgauguccgggugcuggaaccaaucgacguaccgcuugaugacguucgcaacgugcuguuccauaauaacgauaaugcucagaccaugcgauugcucugcaugcuguacacuccccugcguacaggggccaguuccucuggaagcgacccuuuugucauugcagguagagugcucaccuguccaacgcaggauuucaacuuuuuauuccuggugcccccugacgucgaacagaaaacuaagccauuuuccguucccaacaucccgcuuaauuugaugucaaacaguagggugccugcucugauagauggcaugaccguaagcucugaccaaaaucaggugguccaguuccaaaacgggcgggugacacuagacggacagcuccagggcacuaccgccguuuccgcgucaugcguggccaaaauucgcgguagaaucuuuagcaaugcaagucacuaugggauuaaccugacagaggucgauggaacccaauaccaugcuuucgacucucccgccccacuuggcuucccugauuuuggcaauugugacuggcacgugacggggacuaaggcuucccagggagaucugcagacagacaaccccaccaucagcgguacuaucaagucguaugagucuuccuucgccccacacuugggcacaguaaggauugaaggggaugacaaugagcucgcacgguuuaacggaaaagauguucuguuaaaucugaccugguucucacagcgcaacggcagucaacucaaucuuuggacgauacccagcuacgguuccaaccugaccgaagccucucaguuggcuccuccaaucuauccgcccggguuuggcgaggcgauuguguacuucacaagcacuuuuccugcaaucucacgaccaaguguccccugcaccaugccucaggaguucgugucccauuuugucaaugaacaggccccaacaagaggagaggcugcccuacugcacuaccucgaccccgauacucauaggaaccugggcgaguucaagauguauccggaaggguuuuucaccugugugccuaacgcaggagguagcggcccacaaacacuucccauaaaugggguuuuuguguucguaucuugggucucacgguacuaucagcugaaaccugugggaaccguuggcaugacucgucgcuuguga

SEQ ID NO: 21422 - RNA, 1617 nt, Artificial Sequence
  derived and/or modified sequence opt3 from VP1__Norovirus_and/or_Norovirus-like__AF538679
augaagauggccagcaaagacgcucccaccaacauggauggcacauccggggcaggacagcuggugccuggugccaauacugcggagccacucccgaucaagcccgucgcuggcgccgcaacggccguugcuaccgcagggcaagugaacaugauugacccuuggauaaugaauaacuucguacaggccccacagggagaauuuacaaucucucccaauaacacuccuggcgauauucuuuucgaccugcaguuggguccacacuuaaaucccuuucuggcucaucuaucaagaauguacaacgggugggugggaaauaugcaagucaggaucaugcucgccggcaacgcguucagugcaggcaaaauuaucgugugcuguauaccuccaggguuuagcucccagucuaucucgauugcccaggcuaccauguucccgcacguuaucgccgaugugcggguccuggagcccauugacgugccucuugaugacguacgcaauguucuguuucauaacaaugauaacccacagacaaugcgauugcucugcaugcuguauacuccccugcguucaggaggugcaagcaguggcaccgacccuuucgugaucgcugggagaguccucacauguccaacccccgauuuuuccuucuuauuucuggugccgccugacauagaacaaaggacgaagcccuucucugugccaaauauuccuaugaaccuuaugagcaacucccggguccccauguugaucgauggaaugaugguuucaaaugaccagaaccaggugccacaguuucaaaauggccgcguaacucuggacggucagcuacaggggaccacaacugugagugccgcgugcauugccagaaugaggggacggaucuucaacaauaacggcaauuacggcgucaaccucgcagagcuggaugggaaucccuaucacgcuuucgacagcccugccccacuuggauuuccggauuucgguaacugugaccugcauaugaccuuugugaaaaucaaucccacagaauugucuaccggcgauccuuccgggaagguugugauucacucauacgacgcuacguucgccccacaccucggaacugucaagcuggaggauaacaaugaguuagaccaauuugugggcaaagaaguaguucuggagcucacaugggugagcaaccgcaccggugcaacucuuaaucugugggccguccccaacuaugggaguaacuugacacaggcuucucagcuagcgccuccaauauaucccccgggcuucggagaagcaaucguguacuuuaccuccacguucccuaccgucagcaauccaaaggugcccugcacacugccucaggaguuuguuucgcauuucgugaacgagcaagcccccacucgaggcgaugcugcccuccugcacuacguagacccagauacccauagaaaucuuggggaauuuaaaauguacccugagggauauaugacauguguccccaacgcaggcggugggccacagacucugccgauuaauggaguguucguuuuuaucucuuggguguccagguacuaucaguugaagccugucggcaccgccggugcugcccggcgucucuga

SEQ ID NO: 21423 - RNA, 1617 nt, Artificial Sequence
  derived and/or modified sequence opt3 from VP1__Norovirus_and/or_Norovirus-like__JQ743332
augaugauggccagcaaggacgcuucccagucugcagauggcgccucaggggcgggacaacuggugcccgaggucaacaccgcugacccucucccaauggaaccgguugccggucccacaacugcaguggccacggcuggccagguaaauaugaucgauccuuggauugugaacaauuucguccagaguccacagggggaguuuaccauaagccccaacaauacaccuggagacauccuuuucgaucugcaauugggcccacacuuaaaccccuuucugucccaucuaucucagauguacaaugguuggguggggaacaugagaguuaggauucuccuggcaggaaaugccuucucggcuggcaaaaucauugugugcugugucccuccaggcuuuacuucaagcagucuuaccaucgcccaggcgacacuguucccgcacgugauagcagacguacggaccuuggaacccaucgagaugccucucgaagauguucgcaacgugcuguaucauacuaaugacaaccagccaacaaugcgacuggucugcaugcucuacacccccuuacguaccgggggagguuccggcaauucugauagcuuugugguggccgggagaguccugacugcuccuuccucagacuucaguuuucuuuucuugguuccacccaccauugagcaaaagacaagggccuuuacugugccgaacaucccucugcagacccuaagcaauucucgguuccccucccucauucagggaaugauccugucaccagaugcaagccagguagugcaauuucagaacggccgcugucuuauagacggucagcuguuggggacaaccccugcuacgaguggacaacucuucagagucaggggcaaaauuaaccagggcgcccggacucugaauuuaacagagguggaugggaagcccuucauggcguuugacucuccagcccccguuggauucccugacuuugguaaaugcgauuggcacaugcgcaucuccaagaccccaaacaauacuagcucgggcgacccgaugcgaucuguguccguccagacaaacgugcagggguucguaccccaucugggaucaauucaauuugaugaaguuuucaaucacccuaccggcgacuauaucgguacgaucgaguggauuagucagccaagcacgcccccugggacagauauaaaccucugggaaaucccagacuacggcuccucucuuagccaggcagcuaaucuggcucccccgguguuuccuccaggauucggcgaggccuuggucuauuuugugucagccuuccccgggccuaacaauagaagugcacccaacgaugucccaugucuacugccucaggaguacauuacucacuuuguguccgaacaagcccccaccaugggagacgcugcgcuccugcauuauguugauccagacacaaauaggaaccuuggugaguucaagcuguacccgggcggguacuugacuugcgugccuaauggaguaggcgcagguccccagcagcucccacugaacggggucuuuuuauucgugagcuggguuucucgguucuaucagcugaaacccgugggcaccgccucaacagcucguuga

SEQ ID NO: 21424 - RNA, 1617 nt, Artificial Sequence
  derived and/or modified sequence opt3 from VP1__Norovirus_and/or_Norovirus-like__GQ856470
augaugauggccagcaaggacgcucccaccaacauggauggcacauccggggcaggacagcuggugccugaggucucuacugccgaaccaaucucaauggagccgguugcgggugcugccacggcagccgcuaccgcaggccaagugaauaugauugaccccuggauaaugaguaacuacguacaggccccucagggggaguucacaaucagcccaaauaacacucccggagauauucucuuugaccuucagcugggcccucacuugaauccauucuuaucccaucuggcucaaauguauaacgguuggguggggaauaugaaagucagagugcuacucgccggaaacgcguuuaccgcaggcaagaucauuaucucuugcguucccccuggcuucgccgcucagaaugugucgauagcccaggcaacaauguuuccacacgucaucgcugaugugaggguacuggaaccgauugaaguuccccuugaggacgugcggaacguccuguuccauaauaacgauucaaccccuacuaugcgcuugaucuguaugcucuacacaccacugcgagccagcgggaguuccucuggaaccgaccccuuugugauugcgggucgugugcugacgugcccuagcccagauuucaauuuucucuucuuaguucccccgaacguugagcagaaaacuaagccuuuuuccgugcccgaccugccacuuaauguauugucaaacaguagagugccuagccugaucaaaucuaugauggucucccaagaucacggccagauggugcaguuccagaacgggaggguuacccuagacggacaacuccagggcacaacucccaccucagccagccagcuguguaagauacgggguacaguguaucaugcaaccgggggacaaggccuuaaucugacggaaauugauggcacuccauaccacgcuuuugagagucccgccccuaucggguucccagacuugggagaaugcgacuggcacauuaacgcuucuccggccaaugcauucacagaugguuccaucauccaucgcauugacgucgugcaggaucccaccuuugccccucaccucggcacuauacauuauacaaacgcuaauuacgacgcgaacguaagccugaucuguucguuagaguggcugucuccacccuccgggggagcacucaaggccaauccuugggcuauuccaagauauggcucaacccuuacggaggccgcacagcuggcucccccgaucuacccuccagguuucggggaagccauagucuuuuucaugagugauuuucccauugccaacggcagcgacggauuguccgugccuugcaccaucccccaggaguucgucacacacuuugugaaugaacaagcaccaacuaggggcgaggcggcucuacugcacuacgucgauccugacacccaucggaaccucggggaguucaaacuguaucccgaaggauuuaugacaugugugccaaauucuagcgguucaggcccgcagacucuuccuaucaacgggguuuucaccuuuauuaguugggugucccgcuucuaccagcugaagcccguaggaacaaccggcccaguccgaagauuguga

SEQ ID NO: 21425 - RNA, 1617 nt, Artificial Sequence
  derived and/or modified sequence opt3 from VP1__Norovirus_and/or_Norovirus-like__JN603244
augaugauggccagcaaggacgcucccaccaacauggauggcacauccggggcaggacagcuggugccugaggucucuacugccgaaccaaucucaauggagccgguugcgggugcugccacggcagccgcuaccgcaggccaagugaauaugauugaccccuggauaaugaguaacuacguacaggccccucagggggaguucacaaucagcccaaauaacacucccggagauauucucuuugaccuucagcugggcccucacuugaauccauucuuaucccaucuggcucaaauguauaacgguuggguggggaauaugaaagucagagugcuacucgccggaaacgcguuuaccgcaggcaagaucauuaucucuugcguucccccuggcuucgccgcucagaaugugucgauagcccaggcaacaauguuuccacacgucaucgcugaugugaggguacuggaaccgauugaaguuccccuugaggacgugcggaacguccuguuccauaauaacgauucaaccccuacuaugcgcuugaucuguaugcucuacacaccacugcgagccagcgggaguuccucuggaaccgaccccuuugugauugcgggucgugugcugacgugcccuagcccagauuucaauuuucucuucuuaguucccccgaacguugagcagaaaacuaagccuuuuuccgugcccaaucugccacuuaacguauugucaaacaguagagugccuagccugaucaaaucuaugauggucucccaagaccacggccagauggugcaguuccagaaugggaggguuacccuagauggacaacuccagggcacaacucccaccucagccagccagcuguguaagauacgggguacaguguaucaugcaaccgggggacaaggccuuaaccugacggaaauugacggcacuccauaccacgcuuuugagagucccgccccuaucggguucccagauuugggagaaugcgacuggcacauuaaugcuucuccggccaacgcauucacagacgguuccaucauccaucgcauugaugucgcccaggacagcaccuuugcuccccaccucggcacuauacauuauacaaaugcggauuacaacgcaaauguggggcugaucuguucguuagaguggcugucuccuccauccggaggcgcccccaagguaaacccuugggcuauuccaagauaugguucaacccucacggaggccgcacagcuugcucccccgaucuacccuccaggguucggcgaagccauagucuuuuucaugagugacuuucccauugccaauggaagcgauggccuguccgugccuugcaccaucccccaggaguucgucacacacuuugugaacgaacaagcaccaacuaggggagaggcggcuuugcuacacuacgucgacccugauacccaucggaaucugggggaguucaaacucuaucccgaagguuuuaugacaugugugccaaacucuagcggcucagggccgcagacucugccuaucaauggaguuuucaccuuuauuaguugggugucccgcuucuaccagcuuaagcccguaggcacaaccgguccaguccgaagacuguga

SEQ ID NO: 21426 - RNA, 1617 nt, Artificial Sequence
  derived and/or modified sequence opt3 from VP1__Norovirus_and/or_Norovirus-like__AB078335
augaugauggccagcaaggacgcuccccaguccgcagauggcgccucuggggcgggacaacuggugccugaggucaacaccgcugacccacucccgauggaacccguugccgguccuacaacugcaguggccacggcuggccagguaaauaugaucgauccauggauugugaacaauuucguccagucaccccagggggaguuuaccauaaguccuaacaauacaccaggagacauccuuuucgaucugcaauugggcccccacuuaaacccuuuucugagccaucuaucccagauguacaaugguuggguggggaacaugagaguuaggauucuccuggcaggaaaugccuucucugcuggcaaaaucauugugugcugugucccaccgggcuuuacuucgucaagccuuaccaucgcccaggcgacacuguucccccacgugauagcagacguacggaccuuggaaccuaucgagaugccacucgaagauguucgcaacgugcuguaucauacuaaugacaaccagcccacaaugcgacuggucugcaugcucuacaccccuuuacguacugggggagguaguggcaauuccgauucuuuugugguggccgggagaguccugacggcuccaagcuccgacuucucauuucuuuucuugguucccccgaccauugagcaaaagacaagggccuuuacugugccuaacaucccccugcagacccuaaguaauagccgguucccaucucucauucagggaaugauccuguccccugaugcaucacagguagugcaauuucagaacggccgcugucuuauagacggucagcuguuggggacaacccccgcuacgagcggacaacucuucagagucaggggcaaaauuaaccagggcgcccggacucugaauuuaacagagguggaugggaagccauucauggcguuugacagucccgccccuguuggauucccagacuuugguaaaugcgauuggcacaugcgcaucucuaagaccccgaacaauacuuccagcggcgaccccaugcgaucggugucuguccagacaaacgugcagggguucguaccucaucugggauccauucaauuugaugaaguuuucaaucacccaaccggcgacuauaucgguacgaucgaguggauuucacagcccaguaccccuccagggacagauauaaaccucugggaaauccccgacuacggcagcucccuuucucaggcagcuaaucuggccccgccuguguuuccacccggauucggcgaggcuuuggucuauuuugugagcgccuucccugggcccaacaauagaucagcaccaaacgaugucccuugucuacugccccaggaguacauuacucacuuugugagugaacaagccccaaccaugggagacgcugcgcuccugcauuauguugauccggacacaaauaggaaccuuggugaguucaagcuguacccuggcggguacuugacuugcgugcccaauggaguaggcgcagguccacagcagcucccccugaacggggucuuuuuauucguguccuggguuagccgguucuaucagcugaaaccugugggcaccgccucuacagcucguuga

SEQ ID NO: 21427 - RNA, 1617 nt, Artificial Sequence
  derived and/or modified sequence opt3 from VP1__Norovirus_and/or_Norovirus-like__GU299761
augaugauggccagcaaggacgcucccaccaacauggauggcacauccggggcaggacagcuggugccugaggccaauacugcggaaccacucccgaucaaacccgucgcuggugccgcaacggccguugcuaccgcaggccaagugaacaugauugacccuuggauaaugaauaacuucguacaggccccacagggggaguuuacaaucucucccaauaacacuccuggagauauucuuuucgaccugcaguugggcccacacuuaaaucccuuucuggcucaucuaucaagaauguacaacgguuggguggggaauaugcaagucaggaucaugcucgccggaaacgcguucagugcaggcaagauuaucgugugcuguauaccuccaggcuuuagcucccagucuaucucgauugcccaggcuaccauguucccgcacguuaucgccgaugugcggguccuggaacccauugacgugccucuugaugacguacgcaauguucuguuucauaacaaugauaacccacagacaaugcgauugcucugcaugcuguauacuccccugcguucagggggaaccagcagugguacagacccuuucgugaucgcaggcagaguccucaccuguccaacgcccgauuuuuccuucuuauuucuggugccgccugacauagagcaaaggacuaaacccuucucugugccaaauauuccuaugaaccuuaugagcaacucccgggucucaauguugaucgaugggaugaugguuaguaaugaccagaaccaggugccccaguuucaaaauggacgcguaacccuggacggccagcuacaggguacaacuaccgugagcgcugccugcgucgcgagaaugagggggcggauuuucaacaauaacggaaauuacggcgugaaccucacagaacuggauggcaauccauaucacgccuucgacucucccgcaccucuuggguuuccagauuucggaaacugugaccugcauaugaccuuuguuaagaucaauccgaacgaguuguccucaggugaucccagcggcaaaguggucauccacaguuacgacgcuacguucgccccucaccucgggacugugaagcuggagaaugaugacgaauuagcucgcuuuguaggaaaggagguugugcuggaacucacaugggucucuaaccgagagggcgccacccuuaaucugugggcagugccaaacuaugguuccagcuugacucaagccucgcagcuagcucccccuauuuacccacccggguucggcgaggcgauagucuauuuuacaucuaccuucccgacgguguccaacccuaaaguuccaugcacccugccccaggaauuugugucacauuucguaaaugagcaggcaccuacaagaggagaugccgcucuccugcacuacgucgaccccgauacucauaggaaccuuggcgaauuuaagauguacccagagggguauaugaccugugugccuaaugccggagguggcccccaaacacugccaaucaacgggguuuucguguuuauuaguugggucagccgguacuaucaguugaaaccggugggaacugcaggcgccgcucgucgccucuga

SEQ ID NO: 21428 - RNA, 1617 nt, Artificial Sequence
  derived and/or modified sequence opt3 from VP1__Norovirus_and/or_Norovirus-like__AJ277610
augaugauggccagcaagggcgcuccccaguccgcagacgggucuucaggagccggucaacuggugccugaggucaacaccgcggauccacucccgauggaacccguugcuggcccuacaacugccguggcaacggccgggcagguaaauaugaucgacccauggauugugaacaauuucguccagaguccccagggagaguuuaccauaagcccuaacaauacaccaggcgauauccuuuucgaccugcaauuggguccccacuuaaacccuuuucugucccaucuaucucagauguacaaugggugggugggaaacaugagaguuaggauucuccuggcuggcaaugcauucucggccggcaaaaucauugugugcugugucccaccgggguuuacuucaagcagucuuaccaucgcucaggccacacuguucccccacgugauagcggauguacggaccuuggaaccuaucgagaugccacucgaagacguucgcaacgugcuguaucauacuaaugauucccagcccacaaugcgacuggucugcaugcucuacaccccuuuacguacgggagguggcucugggaacagcgacuccuuugugguggcaggaagaguccugacugccccaucaagugauuucagcuuucuuuucuugguucccccgaccauugagcaaaagacaagggcuuuuacugugccuaauaucccccugcagacccuaucuaacucccgguucccaucacucauucagggcaugauccugagcccugacgccagucagguagugcaauuucagaauggucgcugucuuauagaugggcagcuguugggaacaacccccgcaacgucuggccaacucuucagagucaggggcaaaauuaaccagggggcucggacucugaacuuaacagagguggacggaaagccauucauggccuuugauucccccgcgccuguugguuucccagacuuuggcaaaugcgacuggcacaugcgcgugagcaagaccccgaauaacacuucgucuggggaucccaugcgauccgucucagugcagacaaauguacagggauucguuccucaucugggcaguauccaauuugacgaaguguucaaccacccaaccggugauuauauugggacgaucgaguggaucagccagcccuccaccccucucggcacagacauuaaucuuugggaaauaccagauuacggaucuagccugucacaggccgcaaacuuggcucccccggucuuuccuccaggcuucggggaggcccuaguguauuuugucagugcuuuccccggaccuaauaacagauccgcccccaaugacgugccaugucugcucccucaggaguacaucacucacuuuguuagcgaacaagcacccaccaugggugaugccgcucugcuucauuauguggacccagauacaaacaggaaucugggcgaguucaaguuguacccugggggauaccucacuugcguaccgaacggcgucggugcggggccccagcagcugccauuaaauggcguguuucuguucguuucuugggugucacgguucuaucagcuaaaacccgucggaaccgcaaguacagcccguuga

SEQ ID NO: 21429 - RNA, 1617 nt, Artificial Sequence
  derived and/or modified sequence opt3 from VP1__Norovirus_and/or_Norovirus-like__GQ856462
augaugauggccagcaaggacgcucccaccaacauggauggcacauccggggcaggacagcuggugccugaggccaauacugcggaaccacucccgaucaaacccgucgcuggugccgcaacggccguugcuaccgcaggccaagugaacaugauugacccuuggauaaugaauaacuucguacaggccccacagggggaguuuacaaucucucccaauaacacuccuggagauauucuuuucgaccugcaguugggcccacacuuaaaucccuuucuggcucaucuaucaagaauguacaacgguuggguggggaauaugcaagucaggaucaugcucgccggaaacgcguucagugcaggcaagauuaucgugugcuguauaccuccaggcuuuagcucccagucuaucucgauugcccaggcuaccauguucccgcacguuaucgccgaugugcggguccuggaacccauugacgugccucuugaugacguacgcaauguucuguuucauaacaaugauaacccacagacaaugcgauugcucugcaugcuguauacuccccugcguucagggggaaccagcagugguacagacccuuucgugaucgcaggcagaguccucaccuguccaacgcccgauuuuuccuucuuauuucuggugccgccugacauagagcaaaggacuaaacccuucucugugccaaauauuccuaugaaccuuaugagcaacucccgggucucaauguugaucgaugggaugaugguuaguaaugaccagaaccaggugccccaguuucaaaauggacgcguaacccuggacggccagcuacaggauacaacuaccgugagcgcugccugcgucgcgagaaugaggggucggauuuucaacaauaacgggaauuacggagugaaccucacagaacuggacggcaauccauaucacgccuucgauucucccgcaccucuuggcuuuccagacuucgggaacugugaucugcauaugaccuuuguuaagaucaauccgaacgaguuguccucaggagaccccagcgguaaaguggucauccacaguuacgaugcuacguucgccccucaccucggcacugugaagcuggagaaugacgaugaauuagcucgcuuuguagggaaggagguugugcuggaacucacaugggucucuaaccgagagggagccacccuuaaucugugggcagugccaaacuauggcuccagcuugacucaagccucgcagcuagcucccccuauuuacccacccgguuucggggaggcgauagucuauuuuacaucuaccuucccgacgguguccaacccuaaaguuccaugcacccugccccaggaauuugugucacauuucguaaaugagcaggcaccuacaagaggcgacgccgcucuccugcacuacgucgaucccgacacucauaggaaccuuggagaauuuaagauguacccagagggcuauaugaccugugugccuaaugccgggggagguccccaaacacugccaaucaacggcguuuucguguuuauuaguugggucagccgguacuaucaguugaaaccgguggggacugcaggagccgcucgucgccucuga

SEQ ID NO: 21430 - RNA, 1617 nt, Artificial Sequence
  derived and/or modified sequence opt3 from VP1__Norovirus_and/or_Norovirus-like__AF435807
augaagauggccagcaaagacgcuccccaguccgcagauggcgccucuggggcgggacaacuggugccugaggucaacaccgcugacccacucccgauggaacccguugccgguccuacaacugcaguggccacggcuggccagguaaauaugaccgauccauggaucgugaacaauuucguccagucaccccagggggaguuuacaauuaguccuaacaauacuccaggagacauacuuuucgaucugcaauugggcccccacuuaaacccuuuucugagccaucuaucccagauguacaaugguuggguggggaacaugagaguuaggauccuccuggcaggaaaugccuucucugcuggcaagauuaucgugugcugugucccaccgggcuuuaccucgucaagccuuacaauugcccaggcgacccuguucccccacgugaucgcagacguacggacuuuggaaccuauagagaugccacucgaagauguucgcaacgugcuguaucauacaaaugacaaccagcccaccaugcgacuggucugcaugcucuacacgccuuuacguacugggggagguaguggcgauuccgacucuuuugugguggccgggaaaguccugaccgcuccaagcuccgauuucucauuucuuuucuugguucccccgacaaucgagcaaaagacuagagccuuuaccgugccuaauauuccccugcagacacuaaguaacagcagguucccaucucucauccagggaaugauucuguccccugacgcaucacagguagugcaauuucagaauggccggugucuuaucgauggucagcuguuggggaccacgcccgcuacuagcggacaacucuuccgcgucagaggcaaaauaaaccagggcgccaggacacugaacuuaaccgagguggacgggaagccauucauggcguuugacagucccgccccuguuggauucccagauuuugguaagugcgacuggcacaugcggauuucuaaaacuccgaauaacacauccagcggcgaucccaugcgcucggugucuguccagaccaaugugcagggguucguaccucaucugggauccauccaauuugacgaaguuuucaaccacccaacgggcgauuauauugguaccaucgaguggaucucacagcccaguacaccuccagggacugacauuaaucucugggaaauacccgauuacggcagcucccuuucucaggcagcuaaccuggccccgccuguguuuccacccggauucggcgaggcuuuggucuauuuugugagcgccuucccugggcccaauaaccgaucagcaccaaaugacgucccuugucuacugccccaggaguacaucacccacuuugugagugaacaagccccaacaaugggagaugcugcgcuccugcauuauguugacccggauacuaacagaaaucuuggugaguucaagcuguacccuggcggguacuugaccugcgugcccaacggaguaggcgcagguccacagcagcucccccugaauggggucuuuuuauucguguccuggguuagcagguucuaucagcugaaaccugugggcacagccucuaccgcucgguga

SEQ ID NO: 21431 - RNA, 1617 nt, Artificial Sequence
  derived and/or modified sequence opt3 from VP1__Norovirus_and/or_Norovirus-like__KX396056
augaugauggccagcaaggacgcucccaccaacauggauggcacauccggggcaggacagcuggugccugaggccucuacugcggaaccaaucucaauggagccggucgcuggugccgcaacggccgcugcaaccgccggccaaguuaauaugauugaccccuggauaaugaguaacuacgugcaggcuccucagggggaguucacaaucagcccaaauaacacucccggagauauucucuuugaccuucagcugggcccucacuugaauccauucuuaucccaucuggcccaaauguauaacgguuggguagggaauaugaaagugagaguccuacucgcgggaaacgcauuuaccgccggcaagaucauuaucucuugcgugcccccuggcuucgcugcccagaauguuucgauagcacaggcuacaauguuuccacacgugaucgccgaugucagggugcuggaaccgauugaaguaccccuugaggacguucggaacgugcuguuccauaauaacgauucaaccccuacuaugcgcuugaucuguaugcucuacacaccacugcgagcgagcgggaguuccucuggaaccgaccccuuugucauugccggucgugugcugacgugcccuagcccagauuucaauuuucucuucuuagugcccccgaacgucgagcagaaaacuaagccuuuuuccguucccaaucugccacuuaacguguugucaaacaguagaguaccuagccugaucaggucuaugauggugucccaagaccacggccagaugguccaguuccagaaugggcgggugacccuagauggacaacuccagggcacaacucccaccucagcaagccagcuguguaaaauacgcgguacaguuuaucaugcuaccgggggacaaggccuuaaccugacggaaauugacggcacuccauaccacgccuuggagagucccgcuccuaucggguuuccagaucucggagaaugcgacuggcacauuaaugccucuccggcaaacgccuucacagacgguuccaucauccauagaauugauguggcucaggacagcaccuucgcgccccaccugggcacuauacauuauacaaaugcaaacuacgaugccaauaucucguuaauuuguucucuggaguggcucuccccuccaucagggggagcucccaaggucaacccuugggccaucccaagguauggcaguacccuuacggaggcagcccagcuggcucccccgauauacccuccagguuuuggggaagccauuguguucuuuaugagcgacuuccccaucgcaaauggcuccgauggauugucuguaccuugcaccaucccccaggaguuuguuacacacuucgugaacgaacaagcgccaacucggggcgaggcugcccuacugcacuacgucgacccugauacccaucgcaaucucggggaauuuaagcuguaucccgagggauucaugacaugugugccaaacagcucagguaguggcccgcagacucuuccuauuaauggggucuuuaccuucaucuccugggugagccgauuuuaccagcugaaacccguuggaacaaccggcccagugagaagguuguga

SEQ ID NO: 21432 - RNA, 1617 nt, Artificial Sequence
  derived and/or modified sequence opt3 from VP1__Norovirus_and/or_Norovirus-like__AB187514
augaugauggccagcaaggacgcucccaccaacauggauggcacauccggggcaggacagcuggugccugaggccucuacugcggaaccaaucucaauggagccggucgcuggugccgcaacggccgcugcaaccgccggccaaguuaauaugauugaccccuggauaaugaguaacuacgugcaggcuccucagggggaguucacaaucagcccaaauaacacucccggagauauucucuuugaccuucagcugggcccucacuugaauccauucuuaucccaucuggcccaaauguauaacgguuggguagggaauaugaaagugagaguccuacucgcgggaaacgcauuuaccgccggcaagaucauuaucucuugcgugcccccuggcuucgcugcccagaauguuucgauagcacaggcuacaauguuuccacacgugaucgccgaugucagggugcuggaaccgauugaaguaccccuugaggacguucggaacgugcuguuccauaauaacgauucaaccccuacuaugcgcuugaucuguaugcucuacacaccacugcgagcgagcgggaguuccucuggaaccgaccccuuugucauugccggucgugugcugacgugcccuagcccagauuucaauuuucucuucuuagugcccccgaacgucgagcagaaaacuaagccuuuuuccguucccaaucugccacuuaacguguugucaaacaguagaguaccuagccugaucaaaucuaugauggugucccaagaccacggccagaugguccauuuccagauagggagggugacccuagauggacagcuccaaggcacaacucccaccucagcaagccagcuguguaagauucgggguacaguuuaucacgcuaccgggggacagggccuuaaucugacggaaaucgacggcacuccauaccacgccuuugagagucccgcuccuauuggguucccagauuugggagaaugcgacuggcauaucaacgccucuccggcaaaugccuucacagacgguuccaucauucaccgcauagauguggcucaagacagcaccuuugcgccccaucucggcacuauccacuauacaaacgcaaauuacgaugccaacgucucgcugauuuguucuuuagaguggcuguccccuccaucagggggagcucccaaggugaauccuugggccaucccaagauauggcaguacccucacggaggcagcccagcuugcucccccgauauacccuccagguuucggggaagccauuguauuuuucaugagcgacuuucccaucgcaaacggcuccgauggacugucuguuccuugcaccaucccccaggaguucgugacacacuuugucaaugaacaggcgccaacuaggggcgaggcugccuugcuacauuacguggacccugauacccaccggaaccugggggaguucaaacucuaucccgaaggauuuaugacaugugucccaaauagcucagguaguggcccgcaaacucugccuauuaacgggguguucaccuuuaucuccuggguuagccgcuucuaccagcuuaagcccgugggaacaaccggcccaguacgaagacuguga

SEQ ID NO: 21433 - RNA, 1617 nt, Artificial Sequence
  derived and/or modified sequence opt3 from VP1__Norovirus_and/or_Norovirus-like__L07418
augaugauggccagcaaggacgcuccccaguccgcagauggcgccucuggggcgggacaacuggugccugaggucaacaccgcugacccacucccgauggaacccguugccgguccuacaacugcaguggccacggcuggccagguaaauaugaucgauccauggauugugaacaauuucguccagucaccccagggggaguuuaccauaaguccuaacaauacaccaggagacauccuuuucgaucugcaauugggcccccacuuaaacccuuuucugagccaucuaucccagauguacaaugguuggguggggaacaugagaguuaggauucuccuggcaggaaaugccuucucugcuggcaaaaucauugugugcugugucccaccgggcuuuacuucgucaagccuuaccaucgcccaggcgacacuguucccccacgugauagcagacguacggaccuuggaaccuaucgagaugccacucgaagauguucgcaacgugcuguaucauacuaaugacaaccagcccacaaugcgacuggucugcaugcucuacaccccuuuacguacugggggagguaguggcaauuccgauucuuuugugguggccgggagaguccugacggcuccaagcuccgacuucucauuucuuuucuugguucccccgaccauugagcaaaagacaagggccuuuacugugccuaacaucccccugcagacccuaaguaauagccgguucccaucucucauucagggaaugauccuguccccugaugcaucacagguagugcaauuucagaacggccgcugucuuauagacggucagcuguuggggacaacccccgcuacgagcggacaacucuucagagucaggggcaaaauuaaccagggcgcccggacucugaauuuaacagagguggaugggaagccauucauggcguuugacagucccgccccuguuggauucccagacuuugguaaaugcgauuggcacaugcgcaucucuaagaccccgaacaauacuggcuccggggaccccaugcgaagcgugucgguccagacaaacgugcagggauucguaccucaucugggcucuauucaauuugaugaaguuuucaaucacccaaccggugacuauaucgggacgaucgaguggauuucccagcccucaaccccuccaggcacagauauaaaccucugggaaauccccgacuacggaaguagccuuucccaggcagcuaaucuggccccgccuguguuuccacccggcuucggggaggcuuuggucuauuuugugucugccuucccuggacccaacaauagaagcgcaccaaacgaugucccuugucuacugccccaggaguacauuacucacuuugugucagaacaagccccaaccaugggugacgcugcgcuccugcauuauguugauccggacacaaauaggaaccuuggcgaguucaagcuguacccugggggauacuugacuugcgugcccaauggcguaggugcagggccacagcagcucccccugaacggcgucuuuuuauucgugaguuggguuucccgguucuaucagcugaaaccugugggaaccgccagcacagcucguuga

SEQ ID NO: 21434 - RNA, 1617 nt, Artificial Sequence
  derived and/or modified sequence opt3 from VP1__Norovirus_and/or_Norovirus-like__FJ515294
augaugauggccagcaaggacgcuccccaguccgcagauggcgccucuggggcgggacaacuggugccugaggucaacaccgcugacccacucccgauggaacccguugccgguccuacaacugcaguggccacggcuggccagguaaauaugaucgauccauggauugugaacaauuucguccagucaccccagggggaguuuaccauaaguccuaacaauacaccaggagacauccuuuucgaucugcaauugggcccccacuuaaacccuuuucugagccaucuaucccagauguacaaugguuggguggggaacaugagaguuaggauucuccuggcaggaaaugccuucucugcuggcaaaaucauugugugcugugucccaccgggcuuuacuucgucaagccuuaccaucgcccaggcgacacuguucccccacgugauagcagacguacggaccuuggaaccuaucgagaugccacucgaagauguucgcaacgugcuguaucauacuaaugacaaccagcccacaaugcgacuggucugcaugcucuacaccccuuuacguacugggggagguaguggcaauuccgauucuuuugugguggccgggagaguccugacggcuccaagcuccgacuucucauuucuuuucuugguucccccgaccauugagcaaaagacaagggccuuuacugugccuaacaucccccugcagacccuaaguaauagccgguucccaucucucauucagggaaugauccuguccccugaugcaucacagguagugcaauuucagaacggccgcugucuuauagacggucagcuguuggggacaacccccgcuacgagcggacaacucuucagagucaggggcaaaauuaaccagggcgcccggacucugaauuuaacagagguggaugggaagccauucauggcguuugacagucccgccccuguuggauucccagacuuugguaaaugcgauuggcacaugcgcaucucuaagaccccgaacaauacuuccagcggcgaccccaugcgaucgguggauguccagacagacgugcagggguucguaccucaucugggaucuauucaauuugaugaaguuuucaaccacccaaccggcgacuauaucgguacgaucgaguggauuucccagcccucaaccccuccagggacagauauaaaucucugggaaauccccgacuacggcaguagccuuucccaggcagcuaaccuggccccgccuguguuuccacccggauucggcgaggcuuuggucuauuuugugucugccuucccugggcccaauaacagaagcgcaccaaaugaugucccuugucuacugccccaggaguacgugacucacuuuguuucagaacaagccccaaccaugggagacgcugcgcuccugcauuauguggauccggacacaaacaggaaucuuggugaguucaagcuguacccuggcggguacuugacuugcguacccaacggagucggcgcagguccacagcagcucccccugaaugggguguuuuuauucguuaguugggugucccgguucuaucagcugaaaccugucggcaccgccagcacagcucguuga

SEQ ID NO: 21435 - RNA, 1617 nt, Artificial Sequence
  derived and/or modified sequence opt3 from VP1__Norovirus_and/or_Norovirus-like__KJ790198
augagaauggccagcgacgaugcuaaguccgcacccucugaccuggagggcgccgggcucgugccugcgaccgcugccccacuuccggucgcacccguugccggagcucaggcagccgaaccuuucgcuggucaaaucaacgugauugauccauggauauacacaaauuuuguacaggcccccacuggcgaguucacggugucaccuaggaacaccccaggggaaguccuggugaauuuggagaucggacccaacuuaaauccuuaucugcagcaccuagcgcagauguacaacggcuaugccggugggguugaagugcaagucauucucgcaggaaaugcuuuuacagccggcaaacugcuuugcgcacuggugccaccgggcuuccccaccaguagcaucacuccugcucaguugacaaugcucccacauaccauuaucgacguacggacuacagaucccguuguggucccuaugccagacgugcgccgaacccuguggcacgaggugcguuccacgacugagccccugaugagacucgucauaauguuauacaccccgaugagggccaacucugggucggaugaagcguuuguugugucaggacggguacugagccgcccugcccccgacuucaacuuuuucuaucuugugccaccuagagucgaggauacaguggaacccuuuaguuugccagaccugaggguugaugagauguccucuagccgguggcagaaucccguggucaugcuacaggcagacccuaaucaaaacaucgcugcccauuggcagaauggucgcuguacuauuaacggcgagcuccuggggaccacaccacgaaaucaguccuggcuucugagaaugaggggaucaguguuggcugccccgggcggucagaaggcaguaaccguuaacguggaucucacggaacccgacgggcaagccuucaguguccugagcggaaacccuggcccagagggcgugcccgacuuucaggcuaucuacaauguccggaugucuacugcguccacaaccgcagggcacacuguggccacaaacggauauauugaacagucagguuacaccccugcuuuaggcacgcugguuauccaagggguggaucucagccagguaccagcccuuggaagugaggucaccaugcaggucguuucuauagaccugaaucauaacauggaucccacacguuugccggacuacaauggcgcagguuucgauggguccguggcccuagcuccuccacuggugcccccucuccccggcgaagugcugcuucgcuuuacuacccugccaauuacaacuagcagaggaucgucuguauccgccaccuuggacugcgcacucccugcggaguggaucacaugguuccuggugcacaacuucguuccccagggcgaugcugccuuacugagguaucggaaucgagggaccggacaaauucuauuugaguguaaacucuacaaggaagguuuccuggcagucgccggcgugucaacucgcacgguguuuccaacaaguggggucuucgaguuuguuagcugggugccgguguucuaucagcuuaccccuguaggauccucuggcgcuagaaaaagguga

SEQ ID NO: 21436 - RNA, 1617 nt, Artificial Sequence
  derived and/or modified sequence opt3 from VP1__Norovirus_and/or_Norovirus-like__KF306212
augaugauggccagcaaggacgcuccccaguccgcagauggcgccucuggggcgggacaacuggugccugaggucaacaccgcugacccacucccgauggaacccguugccgguccuacaacugcaguggccacggcuggccagguaaauaugaucgauccauggauugugaacaauuucguccagucaccccagggggaguuuaccauaaguccuaacaauacaccaggagacauccuuuucgaucugcaauugggcccccacuuaaacccuuuucugagccaucuaucccagauguacaaugguuggguggggaacaugagaguuaggauucuccuggcaggaaaugccuucucugcuggcaaaaucauugugugcuuugucccaccgggcuucacuucgucaagccuuaccaucgcccaggcgacacuguuuccccacgugauagcagacguacggaccuuggaaccuaucgagaugccacucgaagauguucgcaacgugcuguaucauacuaaugacaaccagcccacaaugcgacuggucuguaugcucuacaccccuuuacguacugggggagguaguggcuccucugauagcuucgugguggccgggagaguccugacggcuccauccucagacuuuaguuucuuguuucuuguucccccgaccauugagcaaaagacaagggccuucacugugccuaauaucccccugcagacccuaagcaacucucgguuuccaucccucauucagggaaugauccugucaccugaugcaagccagguagugcaauuccagaauggccgcugccuuauagacggucagcuguuggggacaacccccgcuacgaguggacaacucuucagagucaggggcaaaauuaaccagggcgcccggacucugaacuuaacagagguggaugggaagccauuuauggcguucgacucucccgccccuguuggauuuccagacuucgguaaaugugauuggcacaugcgcaucuccaagaccccgaauaacacuagcucgggcgaccccaugcgaucuguguccguccagacaaaugugcagggguuuguaccucaucugggaucaauucaauucgaugaaguuuuuaaccacccaaccggcgacuauaucgguacgaucgaguggauuagucagcccagcaccccuccagggacagauauaaaucucugggaaauccccgacuacggcuccucucuuagccaggcagcuaaccuggccccgccuguguucccacccggauuuggcgaggcuuuggucuauuucgugucagccuuuccugggcccaauaacagaagugcaccaaaugaugucccuugccuacugccccaggaguacauuacucacuucguguccgaacaagccccaaccaugggagacgcugcgcuccugcauuauguugauccggacacaaacaggaaucuuggugaguuuaagcuguacccuggcggguacuugacuugugugcccaacggaguaggcgcagguccacagcagcucccccugaauggggucuucuuauucgugagcuggguuucucgguuuuaucagcugaaaccugugggcaccgccucaacagcucguuga

SEQ ID NO: 21437 - RNA, 1617 nt, Artificial Sequence
  derived and/or modified sequence opt3 from VP1__Norovirus_and/or_Norovirus-like__KM461694
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagauaacauuucugcugcccagaucacuaugugcccgcacguuauaguggacguccgccagcuugaacccgugcuguugccucucccagauauccgaaauagauuuuuccauuauaaccaggaggacacgccccguaugaggcugguggcaaugcuguacaccccucuccgggcuaauucgggcgaagaugucuuuacaguuucaugucgcguguuaacuagaccagcccccgacuucgaguuuaccuuccugguaccgccuacaguggagagcaagaccaaacccuuuacucuuccaauuuugacacugggcgaacuaaguaacuccagguucccugcggccaucgauaugcucuauaccgaccccaacgagucuauugucgugcaaccacagaaugggcggugcacgcuggauggaacucuucaggguaccacacagcugguucccacucaaaucugugcauuucgcggcaccuugauaagccagaacgcucgagccgcugaccucacagauuccccucagagagccaggaaucacccacugcaugugcaagucaagaacuuagacgggacccaguacgacccgacggaugacauucccgcagugcugggagccaucgauuucaaaggcacuguauucgguguugcuucacagcgggacgugagugggacacaggaacaaggacacuaugcgacccgugcacacgaggcccauauugauacuacagacccuaaguacgcuccaaagcucggcaccauccuuaucaaaagcgaaucuacggauuuuaccacaaaucagcccauucgcuucacuccugucggcaugggggacaacaauuggagacagugggagcugccagauuacuccggaucauugacccuaaacaugaaucuggcccccgcagugagcccgaguuuuccuggugagaggauacucuucuuucggucuaucgucccauccgccggcggguauggaagcggcuacauugacugccugaucccccaggaaugggugcaacacuucuaucaggaggcugccccuucgcagucugcaguugcgcuugugcgauacguaaaccccgauacaggucgcaauauauuugaagcuaagcugcauagagagggguucuugacugucgccaacuccggcaauaacccaauugugguuccucccaauggauauuuuagguucgaagcaugggugaaccaguuuuacacccucgccuga

SEQ ID NO: 21438 - RNA, 1614 nt, Artificial Sequence
  derived and/or modified sequence opt3 from VP1__Norovirus_and/or_Norovirus-like__AB039780
augaagauggccagcaacgacgcugcacccuccaaugauggcgccgcggggcuggugccugagaucaaccacgaagucauggcuauugagccaguugccggagcaucucucgccgcuccggugguaggucagcuuaauauaaucgaccccuggauuagaaacaauuucgugcaagcacccgccggcgaauuuaccgucucaccaaggaacgcucccggggaguuccuguuggauuuagaacugggaccugagcuaaauccauaccucgcccaucuggcgcggauguauaacggccacgccggugggauggaggugcagaucguucuugcaggaaaugcuuuuacagccggcaaaauucuguucgcagugaucccuccuggcuuuccauacgaaaacuugaguccggcucagcucacuaugugcccccaugucgugguagacguucgccagcuggagccuauacugcucccaaugcccgauauccgaaauacguucuuucacuauaaccaaagcaaugggccuaaguuacgucugguggccaugcuuuacaccccauugagagcgaacaaugccggagaagacgucuucacaguguccuguagggugcugacucggcccucuccggauuuugaguucaacuuucuagucccucccucgguugagucaaaaaccaaggcauucacacucccaauucugaaaaucagcgaaaugaccaacagucgcuuuccuauucccguggaccagauguauacuuccagaaaugagaacaucguagugcagccacagaaugguagggucacacuugauggcgaacugcaagggaccacgacuuugcagcccgugucuauaugcggauuccggggcacccuccagacacgccuggcugaccagccuaacuacacuuaucaaguucauuuagagaaucuggaugguagcccaguggacccgaccgaugaaguccccgccccucucgggacaccagacuuccaggcucagcuuuuuggagugauuucccaacgaucaagugacaacgccaccagagcacacgaggccaggguaaauacgaacgaucccacuuucgcuccucagaucgcgcagguucgguuuaagagcccaucuaaugacuucuuugauaacgagcccauuaaguucacaccggugggcaucuccgucgacucacagaauagcuacaaccaauggcuguugccucguuacggcgggcaccuaaccaauaacacucaucuggcaccaagugugucucccauguuuccuggagaacagauccucuucuuucgcuccuucaugcccggugccagcggccacacagauggggcuauugacugucugcuuccacaggagugggucgcccauuuuuaucaggaagcagccaccgcucaaacggauguggcccugauaagauucguuaauccugacaccggaaggguguuguuugagggcaaacuccacaagcaggguuucaucacaauuucgaacucuggggaucaccccaucguaaugccagcaaacggcuacuuccgguuugaagcgugggucaaucaguucuauucccuggcuccggugggaacuggcucagggcgacgcagaauacaguga

SEQ ID NO: 21439 - RNA, 1614 nt, Artificial Sequence
  derived and/or modified sequence opt3 from VP1__Norovirus_and/or_Norovirus-like__AY038599
augaagauggccagcaacgacgcugcacccuccucugauggcgccgcggggguggucccugagaucaaucacgaaguuauggcuauugagccaguggccggagcaucaauagccgcuccgguagugggucagcaaaacaucauugaccccuggaucagaaauaacuucguccaggccccugcaggcgaauuuaccgugaguccaaggaaugcucccggggaguuccugcucgaucuugaacugggaccugacuugaacccauacuuagcccaucuggcgcggauguauaauggccacgccggugggauggagguucagauugugcuagcaggaaacgcuuuuacagccggcaaaauccucuucgcagucauacccccuggcuuuccauacgagaaucugugcccggcucagcuuacuauguguccccaugugguaguugaugugcgccaacuggaaccugucauguugccaaugcccgacauccgaaacacguucuuucacuauaaucaggaugggggaccuaagcuccgucugauugccaugcuguacaccccacucagagcgaacaauagcggugacgauguguucacaguguccugcagggucuuaacucggcccgccccggacuuugaguucaccuuucugguuccucccucuaucgaaucgaaaacaaaggcauucaccauuccagugcuuaaaaucucagagaugacuaacagccgcuuuccuguacccguggaucagauguauacaaguagauccgagggcauagucgugcagccacaaaaugggagggcuaccauugacggagaauugcugggcacgacucuaguuucucccgugagcgucuguaacuucaaggguaaccuccaggccgaggugccugggcagcaucagcuguaccaacuucagcugaccaauuuggauggauccccaaucgacccgacagacgauacucccggcccucucggcugcccagacuucaccgggcuguuauauggaguagcuucacagcggggucccggcgaugccacacgcgcacacgaagcccgaauugacaccgggagugauacguuugcuccuaagaucggacaaguuagauucuacagcacuucuuccgacuuugagacaaaccagccaacccacuucacucccaucggcauuuacauagaagguaauucaagcgauuuuaaccaguggcagcugccgagguaugggggccaucucgcgaauaacaaucaccuugccccugcagugaguccacuguuccccggagagcaaaucuuguuuuuccggucuuuuauuccuggcgcuuccgggcauacaaacggagagauggacugucuacugccccaggaguucguccagcacuuuuaccaggaagccgcaaccgcccguagcgaaguggcucuccugcgcuucgucaauccagauacggguagagcccuuuuugagucgaaacugcacaagcaaggcuucaugaccaucgcaucuuccggggaccauccuauaauuaugcccacaaacggauauuucagguuugaagcgugggugaaucaguucuacucauuggcuccaguuggcacugguagugggcggcgacgcauccaguga

SEQ ID NO: 21440 - RNA, 1614 nt, Artificial Sequence
  derived and/or modified sequence opt3 from VP1__Norovirus_and/or_Norovirus-like__AY054299
augaagauggccagcaacgacgcugcacccuccucugauggcgccgcggggcuggugccugagaucaaucacgaagucauggcuauugagccaguugccggagcaucaauagccgcuccggugguaggucagcaaaacaucauugaccccuggaucagaaauaacuucgugcaggccccugcaggcgaauuuaccgucaguccaaggaaugcucccggggaguuccuccuugaucuggaauugggaccugacuuaaacccauaccuggcccaucuagcgcggauguauaauggccacgccggugggauggaggugcagauuguucucgcaggaaacgcuuuuacagccggcaaaauccuguucgcagugauacccccuggcuuuccauacgagaaucuuagcccggcucagcugacuaugugcccccaugucgugguagauguucgccaauuggaaccugugaugcucccaaugcccgacauccgaaacacguucuuucacuauaaucaggaugggggaccucgucugagacugauugccaugcucuacaccccauuaagggcgaacaauuccggugacgaugucuucacagugucuugucgggugcugacucgccccgccccggacuuugaguucaccuuucuugucccucccucgaucgaaucaaagacaaaagcauucaccauuccaguuuugaagaucagcgagaugacuaacaguagauuuccugugcccguagaucagauguauacauccaggucugagggcauagugguccagccacaaaaugggcgggcuaccauugacggagaacugcuaggcacgacucucgugagccccguuuccgugugcaacuucaaagguaaccugcaggccgaggucccuggggaacaucagcuuuaccagcugcaauugaccaaucucgauggaucaccaaucgacccgacagacgauacucccggcccucugggcuguccagacuucaccggguuacuguauggaguggcuagucagcgcggucccggcgaugccacacgagcacacgaggccagaauugacaccgggagcgauacguacgcuccuaagaucggacagguaagguuuuacucuacuuccucaaacuucgaacggaaucaaccaacacacuuuacccccaucggcauuuauauagaggguaacagcagugacuucaaucaguggcagcucccgcguuacgggggccaucuugcgaacaauaaccaccuggccccugcaguuucuccauuguuucccggagagcagauccuauucuuucgcuccuucauuccuggcgcuagcgggcauacuaauggagaaauggauugccugcucccccaagaguuugugcagcacuucuaucaggaagccgcaacagcccagucggaggucgcucugcuuagauuugugaacccagacaccgguaggguccuguucgaaucuaaguugcacaaacaaggcuuuaugacgaucgccuccucaggggaucauccuauaauuaugcccaccaauggauacuuccgguucgaggcaugggugaaccaguuuuauagucucgcgccaguuggcacagguagcgggcgacgcagaauccaguga

SEQ ID NO: 21441 - RNA, 1614 nt, Artificial Sequence
  derived and/or modified sequence opt3 from VP1__Norovirus_and/or_Norovirus-like__AF195848
augaagauggccagcaacgacgcugcacccuccaaugauggcgccgcggggcuggugccugagaucaaccacgaagucauggcuauugagccaguugccggagcaucucucgccgcuccggugguaggucagcuuaauauaaucgaccccuggauuagaaacaauuucgugcaagcacccgccggcgaauuuaccgucucaccaaggaacgcucccggggaguuccuguuggauuuagaacugggaccugagcuaaauccauaccucgcccaucuggcgcggauguauaacggccacgcgggugggauggaggugcagaucguucuugccggaaaugcuuuuacagccggcaaaauucuguucgcagugaucccuccuggcuuuccauacgaaaacuugaguccggcucagcucacuaugugcccccaugucgugguagacguucgccagcuggagccuauacugcucccaaugcccgauauccgaaauacguucuuucacuauaaccaaagcaaugggccuaagcguagauuaguggccaugcuguacaccccacuuagggcgaacaaugccggagacgaugucuucacaguguccugucggguguugacucgccccucuccggacuuugaguucaacuuucuggucccucccucgguugaaucaaaaaccaaggcauucacacuaccagugcucaaaauuagcgagaugaccaacaguagauuuccuauccccguagaucagauguauacuuccaggaaugaaaacauugugguccagccacagaauggucgggugacacuggacggcgagcuucaagggaccacgacucugcagcccguuucuaucugcggauuccgcggcaccuugcagacacgacucgcugaucagccuaacuacacuuaucaagugcaucuggaaaauuuagacgguagcccagucgauccgaccgacgaggugcccgccccucuggggacaccagacuuccaggcucagcucuuuggaguaauaucccaaagaucaagugauaacgccaccagggcacacgaagcccggguuaauacgaacgaccccacuuucgcuccucagauugcacaggugcguuuuaagagcccaucuacagauuucuccgacaaugagcccaucaaguuuaccccggucggcauuucaguggauagccagaacaguuacaaucaauggcuucugccucgcuacggcgggcacuugacuaacaauacacaucuagcaccaucugucucccccauguucccuggagagcagauccuguuuuucagaucguuuaugcccggugccggcggguucaccgacggagcuaucgauugucuccugccacaggaauggguggcccacuuuuaucaggaggcagccacggcucaaaccgacguugcccuuauuagguucgugaacccugauacaggccggguacuguuugaagguaaauugcauaagcagggguucauaacuaucagcaauucuggcgaccaccccauugucaugccagcaaacggauacuuccgauuugaggcgugggugaaacaguucuauucccucgcuccgguuggcaccgggucaggacgcagaagggugcaguga

SEQ ID NO: 21442 - RNA, 1614 nt, Artificial Sequence
  derived and/or modified sequence opt3 from VP1__Norovirus_and/or_Norovirus-like__AB303927
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaucaaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugagcaauucccgcuuucccgugccacuggagaaacuuuacacgggacccucaagugcguucguugugcagccucagaacgguagauguacuaccgauggcgucuugcuggggacaacucaacuaagcgccgugaauauaugcaccuucaggggagacguaacacauauugcaggcucucacgauuauaccaugaaccucgcuucccagaauuggaacaauuacgacccaacggaggaaaucccggcuccccuggguacuccugacuuuguugggaagauucagggagugcuuacacagaccacucgggaggauggcucaacacgcgcccauaaggccaccgucagcacgggcagugugcacuucaccccaaagcuggggucuguccaauacacaacugacaccaacaaugauuuucagacaggacagaacacuaaauucacccccguggguguuauccaagacggcuccaaucaccagaacgaaccucagcaguggguguugccaaauuauagcgggcgaacaggacauaacguacaccucgcacccgccgucgcuccgaccuuuccuggcgagcaacuguuauucuuuagaucgacuaugccagguuguucuggguaccccaauaugaaccuggauugccuccuuccucaggaaugggugcagcauuucuaucaggaggcggcacccgcccaauccgacguugcucuguugagguuugugaacccagauacgggccggguccuauucgaguguaagcugcacaaaucaggauacgugacaguagcccacaccggcccucaugaccucgugauucccccaaauggguauuuucguuucgauaguuggguuaaccaguuuuacacucuggcaccgaugggaaauggugccggccgcagaagguga

SEQ ID NO: 21443 - RNA, 1614 nt, Artificial Sequence
  derived and/or modified sequence opt3 from VP1__Norovirus_and/or_Norovirus-like__AY038600
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaagugaucuucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacagcacaaucaaguugauugcaaugcucuauacuccacugcgugcuaacaacgccggggaugacgucuucaccguuaguugcagagugcugacaaggcccuccccggauuuugacuucaucuuucucguaccucccaccguggaaucucggacuaaaccauucacagucccuauuuuaaccguggaggaaaugagcaauucccgcuuucccaucccacuggagaaacuuuacacgggacccucaagugcguucguugugcagccucagaacgguagauguacuaccgauggcgucuugcuggggacaacucaacuaagcgccgugaauauaugcaccuucaggggagacguaacacauauugcaggcucucacgauuauaucaugaaccucgcuucccagaauuggaacaauuacgacccaaccgaggaaauuccggcuccccuggguacgccugacuuuguugggaagauccagggaaugcuuacucagacaacccgggaggauggcucaacucgcgcccauaaggccacagugagcaccggcaguguccacuucacgccaaagcuggggucugugcaauacaccacagacacuaacaaugauuugcagaccggacagaacacaaaauuuacucccgucggugugauccaagacggcaauaaccaccagaaugaaccucagcaguggguucucccaaacuauuccgggcgaaccggacauaaugugcaccuggcacccgccguagcuccgacauucccuggcgagcaauuacuguuuuucagaagcaccaugccagguuguucgggguaccccaacaugaaccucgauugccuucugccucaggaauggguccagcauuuuuaucaggaggcggcacccgcccaaucugacguggcuuugcuaagguucguuaauccagauacuggccgggugcuguuugaguguaagcuccacaaauccggauacgucacgguggcccacacaggcccucaugaccugguaauucccccaaacggguauuuccguuuugauucaugggugaaucaguucuacacccuugcaccgaugggaaacggugccggccgcagaagguga

SEQ ID NO: 21444 - RNA, 1614 nt, Artificial Sequence
  derived and/or modified sequence opt3 from VP1__Norovirus_and/or_Norovirus-like__AF080554
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacucaacuaagugccgucaacauuugcaccuucaggggagacgugacacauaucgcaggcagccacgauuauaccaugaaucucgcuucucagaacuggaauaacuacgacccaacggaggaaauuccggcuccccuggguacuccugacuuuguagggaagauccagggaguucuuacacagaccacuaaggaggauggcuccacacgggcccauaaggccaccgugucaacgggcagcguccacuucaccccaaaacuggggagugugcaauacacaacugacaccaauaacgauuuucagacaggacagaauacuaaguucacccccgucggugugauccaagacggcaacaaucaccagaacgaaccucagcaguggguuuugccaaauuauucugggcgcacaggacauaacgugcaccucgcacccgccguagcuccgaccuuuccuggcgagcaacuguuauucuuucgauccacuaugccagguuguagcggguaccccaacaugaaucuggauugccuccuuccucaggaauggguccagcauuucuaucaggaggcggcacccgcccaaucggacguggcucuguugagauuuguuaacccagauacgggcagggugcuauucgaguguaaacugcacaagucuggauacgucacaguggcccacaccggcccucaugaccucguaauucccccaaauggguauuuucgguucgauuccugggugaaccaguuuuacacucuggcaccgaugggaaauggugccggccgucgcagauga

SEQ ID NO: 21445 - RNA, 1614 nt, Artificial Sequence
  derived and/or modified sequence opt3 from VP1__Norovirus_and/or_Norovirus-like__AB294778
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccgugccacuggagaaacuuuacacgggacccuccucagcguucguugugcagccucagaaugguagauguacuaccgauggcgucuugcuggggacaacucaacuaagugccgugaacauaugcaccuucaggggagacguaacacauauugcaggcagccacgauuauaccaugaaucucgcuucucagaacuggaauaacuacgacccaacggaggaaaucccggcuccccuggguacuccugacuuuguugggaagauucagggagugcuuacacagaccacucgggaggauggcuccacacgcgcccauaaggccaccgucucaacgggcagcgugcacuucaccccaaagcuggggaguguccaauacacaacugacaccaauaacgauuuucagacaggacagaauacuaaauucacccccguggguguuauccaagacggcucuaaccaccagaaugaaccucagcaguggguguugccaaacuauuccgggcgaacaggacauaauguacaccucgcacccgccgucgcuccgaccuuuccuggcgagcaacuguuauucuuuagaagcacuaugccagguuguucgggguaccccaacaugaaccuggauugccuccuuccucaggaaugggugcagcauuucuaucaggaggcggcacccgcccaaucugacguugcucuguugagguuugugaauccagauacgggccggguccuauucgaguguaagcugcacaaauccggauacgugacaguagcccacaccggcccucaugaccucgugauucccccaaacggguauuuucguuucgauucauggguuaaucaguuuuacacucuggcaccgaugggaaacggugccggccgcagaagguga

SEQ ID NO: 21446 - RNA, 1614 nt, Artificial Sequence
  derived and/or modified sequence opt3 from VP1__Norovirus_and/or_Norovirus-like__AB303922
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaucaaauuucgugcaggcuccugguggcgaauuuacuguuaguccaaggaacgcacccggggagauccuuuggagcgccccucugggaccagauuugaaucccuacuuaucccaccuggcucggauguauaacggcuacgccgguggguucgaagugcaggucauucuagcgggaaaugcauuuacggccggcaaaaucauuuucgcugccgugccuccaaacuuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaacgccggggaugacguguucacagucaguugcagaguucugaccaggcccuccccggauuuugacuucauuuuucucgugccucccacuguagaaucucggacaaaaccauucaccgugccuaucuuaacggucgaggaaaugagcaacucccgcuuucccauaccacuggagaaacuuuacacuggacccucaagugcguucgugguucagccucagaaugguagauguaccacagauggcguguugcuggggacuacccaacuaagcgccgucaacauuugcacauucaggggagacgugacccauaucgcaggcucucacgauuauacgaugaaucucgcuucccagaacuggaauaacuacgacccaacugaggaaauuccggcuccccuggguacaccugacuuuguagggaagauccagggaguucuuacccagacuacacggggcgauggcucaacccgcgcccauaaggccacggugagcaccgggaguguccacuucacaccaaagcugggaucugugcaauacacuaccgacacaaauaacgauuuucagacuggucagaauaccaaauucacacccgucggcgugauccaagacggggauaaccaccagaaugagccucagcaguggguuuugccaaacuauuccggacgaaccggccauaaugugcaccucgcacccgccguagcuccgacuuuuccuggugaacaacuguuauucuuuagaagcacgaugccaggguguucgggcuaccccaacaugaaucuggacugccuccuuccucaggaguggguccagcauuucuaucaggaagcggcacccgcccaaucugauguggcucuguugagguuuguuaacccagacacaggacgggugcuauucgaguguaagcugcacaaauccggcuacgucaccguggcccacacugggccucaugaucucguaauucccccaaacggauauuuucguuucgacucaugggugaaucaguuuuacacccuggcaccgauggguaacggcgccgggcgcagaagguga

SEQ ID NO: 21447 - RNA, 1614 nt, Artificial Sequence
  derived and/or modified sequence opt3 from VP1__Norovirus_and/or_Norovirus-like__AY532128
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaauauuauagaccccuggaucagaaacaauuucguccaggcuccugguggcgaauuuacagugucaccaaggaacgcacccggggagauucuuuggagugccccucugggaccagauuugaaucccuacuuaagccaccuggcucggauguauaacggcuacgccgguggguucgaaguucaggugauccuagcgggaaaugcauuuacugccggcaaaauuaucuucgcugccgucccuccaaacuuuccgacggagggccucucccccucucaggugaccauguucccucauauaaucguagacguucgccaacuggagccagugcuuauuccccugccugauguccgaaauaacuuuuaucacuacaaucagucgaacgacucaacaaucaaguugauugcaaugcucuauacuccacugcgugcuaacaaugccggggaugacguguucaccgugagcugcagaguccugacaaggcccaguccggauuuugacuucaucuuucucguuccucccaccguggaaucccggacuaaaccauucacaguaccuauauuaaccguggaggaaaugucuaacagccgcuuucccauuccacuggagaaacuuuacacgggacccuccucagcguucgucgugcagccucagaaugguagauguacuaccgauggcguuuugcuggggacaacucaacuaagugccgugaacaucugcaccuucaggggagacgucacacauauugcaggcagccacgauuauaccaugaaucucgcuucucagaacuggaauaacuacgacccaacggaggaaaucccggcuccccuggguacuccugacuuuguggggaagauccagggaauccuuacacagaccacucgggaggauggcuccacacgcgcccauaaggccaccguaucaacgggcagcguucacuucaccccaaagcuggggagugugcaauacacaacugacaccaauaacgauuuucagacaggacagaauacuaaauucacccccgucggugugauacaagacggcaacaaucaccagaacgaaccucagcagugggucuugccaucuuauuccgggcgaacaggacauaaugugcaccucgcacccgccguugcuccgaccuuuccuggcgagcaacuguuauucuuuagaagcacuaugccagguuguucgggguaccccaacaugaaccuggauugccuccuuccucaggaaugggugcagcauuucuaucaggaggcggcacccgcccaaucugacguagcucuguugagguuugucaauccagauacgggccgggugcuauucgaguguaagcugcacaaauccggauacguuacaguggcccacaccggcccucaugaccucgucauucccccaaacggguauuuucguuucgauucaugggugaaucaguuuuacacucuggcaccgaugggaaacggugccggccgcagaagguga

SEQ ID NO: 21448 - RNA, 1614 nt, Artificial Sequence
  derived and/or modified sequence opt3 from VP1__Norovirus_and/or_Norovirus-like__AY532113
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaauauuauagaccccuggaucagaaacaauuucguccaggcuccugguggcgaauuuacagugucaccaaggaacgcacccggggagauucuuuggagugccccucugggaccagauuugaaucccuacuuaagccaccuggcucggauguauaacggcuacgccgguggguucgaaguucaggugauccuagcgggaaaugcauuuacugccggcaaaauuaucuucgcugccgucccuccaaacuuuccgacggagggccucucccccucucaggugaccauguucccucauauaaucguagacguucgccaacuggagccagugcuuauuccccugccugauguccgaaauaacuuuuaucacuacaaucagucgaacgacucaacaaucaaguugauugcaaugcucuauacuccacugcgugcuaacaaugccggggaugacguguucaccgugagcugcagaguccugacaaggcccaguccggauuuugacuucaucuuucucguuccucccaccguggaaucccggacuaaaccauucacaguaccuauauuaaccguggaggaaaugucuaacagccgcuuucccauuccacuggagaaacuuuacacgggacccuccucagcguucgucgugcagccucagaaugguagauguacuaccgauggcguuuugcuggggacaacucaacuaagugccgugaacaucugcaccuucaggggagacgucacacauauugcaggcagccacgauuauaccaugaaucucgcuucucagaacuggaauaacuacgacccaacggaggaaaucccggcuccccuggguacuccugacuuuguggggaagauccagggaaugcuuacacagaccacucgggaggauggcuccacacgcgcccauaaggccaccguaucaacgggcagcguucacuucaccccaaagcuggggagugugcaauacacaacugacaccaauaacgauuuucagacaggacagaauacuaaauucacccccgucggugugauucaagacggcaacaaucaccagaacgaaccucaucagugggucuugccaaauuauucugggcgaacaggacacaacgugcaucucgcacccgccguugcuccgaccuuuccuggcgagcagcuguuauucuuuagauccacuaugccagguuguagcggguaccccaacaugaaucuggauugccuccuuccucaagaaugggugcagcacuucuaucaggaggcggcacccgcccagucggacguagcucuguugagguuugucaacccagauacgggccgggugcuauucgaguguaagcugcacaaaucuggauacguuacaguggcccauaccggcccucacgaccucgucauacccccaaauggguauuuucguuucgauuccugggugaaccaauuuuacacucuggcaccgaugggaaauggugccggccgcagaagguga
